(12) United States Patent
Civin et al.

(10) Patent No.: US 7,799,528 B2
(45) Date of Patent: Sep. 21, 2010

(54) THERAPEUTIC AND DIAGNOSTIC APPLICATIONS OF GENES DIFFERENTIALLY EXPRESSED IN LYMPHO-HEMATOPOIETIC STEM CELLS

(75) Inventors: Curt I. Civin, Baltimore, MD (US); Robert W. Georgantas, III, Towson, MD (US)

(73) Assignee: The Johns Hopkins University, Baltimore, MD (US)

( * ) Notice: Subject to any disclaimer, the term of this patent is extended or adjusted under 35 U.S.C. 154(b) by 168 days.

(21) Appl. No.: 11/199,665

(22) Filed: Aug. 9, 2005

(65) Prior Publication Data

US 2007/0036765 A1    Feb. 15, 2007

Related U.S. Application Data

(63) Continuation of application No. PCT/US2004/004544, filed on Feb. 12, 2004.

(60) Provisional application No. 60/446,938, filed on Feb. 12, 2003, provisional application No. 60/492,632, filed on Aug. 5, 2003, provisional application No. 60/526,419, filed on Dec. 2, 2003.

(51) Int. Cl.
*C12Q 1/68* (2006.01)

(52) U.S. Cl. ......................................................... 435/6

(58) Field of Classification Search ....................... None
See application file for complete search history.

(56) References Cited

U.S. PATENT DOCUMENTS

| | | | |
|---|---|---|---|
| 5,681,559 A | 10/1997 | DiGiusto et al. |
| 6,462,187 B1 | 10/2002 | Bandaru |
| 6,706,867 B1 | 3/2004 | Lorenz |
| 2002/0142462 A1 | 10/2002 | Ildstad et al. |

OTHER PUBLICATIONS

Rhodes et al. Cancer Research 2002 vol. 62 p. 4427.*
Ivanova et al. Science 2002 vol. 298 p. 601.*
Khan et al. Biochem Biophyx Acta 1999 VOI 1423 p. M17.*
Kluger et al. BioEssays 2004 vol. 26 p. 1276.*
Lu et al. Blood 2004 VOI.103 p. 4134.*
Park et al. Blood 2002 vol. 99 p. 488.*
Cheung et al. Nature Genetics 2003 VOI. 33 p. 422.*
Newton et al. Journal of Computational Biology 2001 vol. 8 p. 37.*
Wu et al. Journal of Pathology 2001 VOI. 195 p. 53.*
GeneCard GATA3 www.genecard.org.*
Unigene Hs.172851 NCBI website.*
Revision History for AL136693.1 NCBI website.*
Affymetrix Results Query HG-U133A, HG-U133B from www.affymetrix.com.*
Freeman et al. (PNAS 2002 vol. 99 p. 1341).*
Akashi et al., "Transcriptional accessibility for genes of multiple tissues and hematopoietic lineages is hierachically controlled during early hematopoiesis," Blood, 101(2):383-389 (2003).

Al-Hajj et al., "Prospective identification of tumorigenic breast cancer cells," Proc. Natl. Acad. Sci. U.S.A., 100(7):3983-3988 (2003).
Bhatia et al., "A newly discovered class of human hematopoietic cells with SCID-repopulating activity," Nat. Med. 4(9)1038-45 (1998).
Bonnet, D., "Normal and leukemic CD35-negative human hematopoletic stem cells," Rev. Clin. Exp. Hematol., 5:42-61 (2001).
Cambot et al., "Human Immune Associated Nucleotide 1: a member of a new guanosine triphosphatase family expressed in resting T and B cells," Blood, 99(9):3293-3301 (2002).
Chen et al., "Kruppel-like Factor 4 (Gut-enriched Kruppel-like Factor) Inhibits Cell Proliferation by Blocking G1/S Progression of the Cell Cycle," J. Biol. Chem., 276(32):30423-30428 (2001)..
Chen et al., "Transcriptional profiling of Kurppel-like factor 4 reveals a function in cell cycle regulation and epithelial differentiation," J. Mol. Biol., 326(3):665-677 (2003).
Civin et al., "Highly purified CD34-positive cells reconstitute hematopoiesis," J. Clin. Oncol., 14(8):2224-2233 (1996).
Civin et al., "Antigenic analysis of hematopoiesis, III. A hematopoietic progenitor cell surface antigen defined by a monoclonal antibody raised against KG-la cells," J. Immunology, 133(1):157-165(1984).
Dang et al., "Overexpression of Kruppel-like factor 4 in the human colon cancer cell line RKO leads to reduced tumorigenecity," Oncogene, 22:3424-3430 (2003).
Datson et al., "MicroSAGE: a modified procedure for serial analysis of gene expression in limited amounts of tissue," Nucleic Acid Res., 27(5):1300-1307 (1999).
Eviskov et al., Technical Comment "Comment on "'Sternness': Transcriptional Profiling of Embryonic and Adult Stem Cells and "A Stem Cell Molecular Signature," (II) Science, 302:393c (2003).
Fortunel et al., Technical Comment "Comment on "Stemness':Transcriptional Profiling of Embryonic and Adult Stem Cells and "A Stem Cell Molecular Signature" (I) Science, 302:393b (2003).
Friedman et al., "Regulation of immature myeloid cell differentiation by PEBP2/CBF, Myb, C/EBP and Ets family members," Curr. Top. Microbiol. Immunol., 211:149-157 (1996).
Friedman et al., "The murine myeloperoxidase gene contains a bipartite distal enhancer, including a novel region regulated by PEBP2ICBF," Leuk Res., 20:809-815 (1996).
Glynne et al., "B-lymphocyte quiescence, tolerance and activation as viewed by global gene expression profiling on microarrays," Immunol. Rev., 176:216-246 (2000).

(Continued)

Primary Examiner—Sarae Bausch
Assistant Examiner—Katherine Salmon
(74) Attorney, Agent, or Firm—Foley Hoag, LLP

(57) ABSTRACT

The invention is based at least in part on the discovery of novel group of genes and/or their encoded gene products that are differentially represented in two substantially enriched $CD34^+/CD38^-/Lin^-$ and $CD34^+/[CD38/Lin]^{++}$ hematopoietic cell populations isolated from normal human bone marrow, cord blood, and peripheral blood stem cell preparations.

6 Claims, 9 Drawing Sheets

OTHER PUBLICATIONS

Hemmati et al., "Cancerous stem cells can arise from pediatric brain tumors," Proc. Natl. Acad. Sci. U.S.A., 100(25):15178-15183 (2003).

Honda et al., "Expression of E2A-HLF Chimeric Protein Induced T-Cell Apoptosis, B-Cell Maturation Arrest, and Development of Acute Lymphoblastic Leukemia," Blood, 93(9):2780-2790 (1999).

Hunger et al., "Hlf, a novel hepatic bZIP protein, shows altered DNA-binding properties following fusion to E2A in t(17;19) acute lymphoblastic leukemia," Genes Dev., 6(9):1608-1620 (1992).

Ivanova et al., "A stem cell molecular signature," Science, 298:601-4 (2002).

Khan et al., "DNA microarray technology: the anticipated impact on the study of human disease," Biochim. Biophys. Acta, 1423(2):M17-28 (1999).

Kowalski et al., "Non-parametric, hypothesis-based analysis of microarrays for comparison of several phenotypes," Bioinformatics, 20(3):364-373 (2004).

Krause et al., "CD34: Structure, Biology, and Clinical Utility," Blood, 87(1):1-13 (1996).

Kuo et al., "LKLF: A Transcriptional Regulator of Single-Positive T Cell Quiescence and Survival," Science, 277:1986-1990 (1997).

Lapidot et al., "Identification of Human Juvenile Chronic Myelogeneous Leukemia Stem Cells Capable of Initiating the Disease in Primary and Secondary SCID Mice," Blood, 88(7):2655-2664 83 (1996).

Lapidot et al., "A cell initiating human acute myeloid leukaemia after transplantation into SCID mice," Nature, 367:645-648 (1994).

Larochelle et al., "Identification of primitive human hematopoietic cells capable of repopulating NOD/SCID mouse bone marrow: implications for gene therapy," Nat. Med. 2:1329-1337 (1996).

Livak et al., "Analysis of Relative Gene Expression Data Using Real-Time Quantitative PCR and the $2-\Delta\Delta CT$ Method," Methods, 25:402-408 (2001).

Man et al., "Power Sage: comparing statistical tests for SAGE experiments," Bioinformatics, 16(11):953-959 (2000).

Park et al., "Differential gene expression profiling of adult murine hematopoietic stem cells," Blood, 99(2):488-498 (2002).

Pease et al., "Light-generated oligonucleotide arrays for rapid DNA sequence analysis," Proc. Natl. Acad. Sci. U.S.A., 91:5022-5026 (1994).

Phillips et al., "The genetic program of hematopoietic stem cells," Science, 288:1635-1640 (2000).

Ramalho-Santos et al., "Stemness": transcriptional profiling of embryonic and adult stem cells, Science, 298:597-600 (2002).

Reya et al., "Stem cells, cancer, and cancer stem cell," Nature, 414:105-111 (2001).

Rhodes et al., "Meta-Analysis of Microarrays: Interstudy Validation of Gene Expression Profiles Reveals Pathway Dysregulation in Prostate Cancer," Cancer Res., 62:4427-4433 (2002).

Rosati et al., "CCAAT-Enhancer-Binding Protein β (C/EBPβ) Activates CCR5 Promoter: Increased C/EBPβ and CCR5 in T Lymphocytes from HIV-1-Infected Individuals," J. Immunol., 167:1654-1662 (2001).

Schober et al., "Expression of the Transcription Factor Lung Kruppel-Like Factor Is Regulated by Cytokines and Correlates with Survival of Memory T Cells In Vitro and In Vivo," J. Immunol., 163:3662-3667 (1999).

Shie et al., "Gut-enriched Kruppel-like factor represses cyclin D1 promoter activity through Sp1 motif," Nucleic Acids Res. 28:2969-2976 (2000).

Smith et al., "Disrupted Differentiation and Oncogenic Transformation of Lymphoid Progenitors in E2A-HLF Transgenic Mice," Mol. Cell. Biol., 19(6):4443-4451 (1999).

Steidl et al., "Gene expression profiling identifies significant differences between the molecular phenotypes of bone marrow-derived and circulating human CD34+ hematopoietic stem cells," Blood, 99(6):2037-2044 (2002).

Terskikh et al., "From hematopoiesis to neuropoiesis: Evidence of overlapping genetic programs," Proc. Natl. Acad. Sci. U.S.A., 98(14):7934-7939 (2001).

Vogel, G., "'Sternness' Genes Still Elusive," Science, 302:393 (2003).

Wang et al., "C/EBPalpha and G-CSF receptor signals cooperate to induce the myeloperoxidase and meutrophil elastase genes," Leukemia, 15(5):779-786 (2001).

Wani et al., "Lung Kruppel-like Factor, a Zinc Finger Transcription Factor, Is Essential for Normal Lung Development," J. Biol. Chem., 274(30):21180-21185 (1999).

Zhang et al., "The Gut-enriched Kruppel-like Factor (Kruppel-like Factor 4) Mediates the Transactivating Effect of p53 on the p21WAF1/Cip1 Promoter," J. Biol. Chem., 275(24):18391-18398 (2000).

Zhou et al., "The pattern of gene expression in human CD34+ stem/progenitor cells," Proc. Nat. Acad. Sci., 98(24):13966-13971 (2001).

Zhu et al., "CCAAT/enhancer binding protein-β is a mediator of keratinocyte survival and skin tumorigenesis involving oncogenic Ras signaling," Proc. Natl. Acad. Sci. U.S.A., 99:207-212 (2002).

International Search Report dated Dec. 16, 2005.

* cited by examiner

THERAPEUTIC AND DIAGNOSTIC APPLICATIONS OF GENES DIFFERENTIALLY EXPRESSED IN LYMPHO-HEMATOPOIETIC STEM CELLS

CROSS REFERENCE TO RELATED APPLICATIONS

This application is a continuation of prior International Patent Application No. PCT/US04/04544, filed Feb. 12, 2004, which claims the benefit of U.S. Provisional Application No. 60/446,938, filed Feb. 12, 2003, U.S. Provisional Application No. 60/492,632, filed Aug. 5, 2003 and U.S. Provisional Application No. 60/526,419 filed Dec. 2, 2003, each of which are incorporated herein by reference in their entirety.

BACKGROUND

Tissue and organ transplants save many lives threatened by disease and cancer each year. A particularly medically useful type of transplantation is allogeneic bone marrow transplantation (BMT). Allogeneic bone marrow transplantation may be used to remedy acquired defects in either the hematopoietic system or the immune system, since both types of cells develop from a common stem cell. Furthermore, allogeneic bone marrow transplantation provides a means of correcting inherited enzymatic deficiencies or other genetic defects by providing a self-renewing source of the particular enzyme or other gene product missing in the affected individual.

Still further, allogeneic bone marrow transplantation may be used to treat bone marrow malignancies—i.e. leukemias. Typically, treatment of leukemia involves the use of chemotherapeutic agents which destroy both the patient's normal bone marrow stem cell populations and the leukemia cancer cell populations. Accordingly, allogeneic bone marrow transplantation must be used following high-dose myeloablative chemotherapy and/or radiation therapy to restore the normal red and white blood cell progenitor cell populations in the patient. For the treatment of other cancers not involving the patient's bone marrow, the patient's own bone marrow may be harvested prior to and reinfused following chemotherapy and/or radiation therapy in what is called an autologous bone marrow transplant.

Due to the inability to transfer only the stem cell population, the applicability of allogeneic BMT remains restricted by graft vs. host disease (GVHD), which is apparently mediated mainly by T lymphocytes in the graft cell population. Risk of GVHD has limited allogeneic BMT to use only in highly fatal diseases, and even then, only for patients with HLA-matched donors, usually siblings. Autologous BMT can avoid most of the problems associated with allogeneic transplants. In autologous BMT, however, it is necessary to reintroduce only desirable cell populations free of diseased cell populations (e.g., occult tumor cells) to avoid re-introduction of the disease.

Many of the problems associated with both allogeneic and autologous BMT can be alleviated by using purified stem cell populations for the graft. Purified stem cell populations can be obtained from marrow cell suspensions by positive selection (collecting only the desired cells) or negative selection (removing the undesirable cells), and the technology for capturing specific cells on affinity materials is well developed (Wigzel et al., (1969) *J. Exp. Med.*, 129:23; Schlossman et al., (1973) *J. Immunol.*, 110:313; Mage et al., (1977) *J. Immunol. Meth.*, 15:47; Wysocki et al., (1978) *Proc. Nat. Acad. Sci.*, 75:2844; Schrempf-Decker et al., (1980) *J. Immunol. Meth.*, 32:285; Muller-Sieburg et al., (1986) *Cell*, 44:653).

Monoclonal antibodies against antigens peculiar to mature, differentiated cells have been used in a variety of "negative" selection strategies to remove undesired cells (i.e. to deplete T cells or malignant cells from allogeneic or autologous marrow grafts respectively) (Gee et al., (1988) *J.N.C.I.* 80:154-9; Gee et al., (1987) "*Proc. of* 1st Int. Workshop on Bone Marrow Purging" in Bone Marrow Transpl., Supp. 2, London, MacMillan). Successful purification of human hematopoietic cells by negative selection with monoclonal antibodies and immunomagnetic microspheres has been reported which involved the use of multiple monoclonal antibodies, thus making it more costly for clinical application than positive selection (Griffin et al., (1984) *Blood*, 63:904; Kannourakis, et al., (1987) *Exp. Hematology*, 15:1103-1108). Furthermore most studies report only 1 to 2 orders of magnitude reduction in the target cell level following monoclonal antibody treatment. This may not be adequate T lymphocyte depletion necessary to prevent GVHD in allogeneic transplants, and it is certainly insufficient for the purpose of removing cancer cells in autologous bone marrow transplantation where $10^6$ to $10^9$ malignant cells may be present in the patient's marrow.

Positive selection of normal marrow stem cells is an alternative for treatment of the bone marrow graft. The procedure employs a monoclonal antibody which selectively recognizes human lymphohematopoietic progenitor cells, such as the anti-MY10 monoclonal antibody that recognizes an epitope on the CD34 glycoprotein antigen. Cells expressing the CD34 antigen include essentially all unipotent and multipotent human hematopoietic colony-forming cells (including the pre-colony forming units (pre-CFU) and the colony forming unit-blasts (CFU-Blast)) as well as the very earliest stage of committed B lymphoid cells, but NOT mature B cells, T cells, NK cells, monocytes, granulocytes, platelets, or erythrocytes. See Civin, U.S. Pat. No. 4,714,680. This method of isolating $CD34^+$ cells results in a mixed cell population of stem and progenitor cells that includes all lineages and stages of lympho-hematopoietic stem and progenitor cells and some later precursor cells. Such positive selection procedures additionally suffer from some disadvantages including the presence of materials such as antibodies and/or magnetic beads on the $CD34^+$ cells, and damage to the cells resulting from the removal of these materials. In addition, researchers want to focus down on only the most primitive of the cells within the $CD34^+$ cell population (see below).

Accordingly, there is a continued interest in finding other methods to either replace or augment current methods of isolating cell populations that are enriched in primitive in vivo engrafting hematopoietic stem cells. One way to achieve this is to gain a better understanding of the molecular signature of in vivo engrafting hematopoietic stem cells and on this basis, develop better methods of obtaining purer populations of such stem cells.

The study of hematopoiesis until recently, has been limited because of the complexity of isolating a homogenous purified stem cell population. A small number of in vivo engrafling (lympho-)hematopoietic stem cells (HSCs), present in bone marrow (BM), placental/umbilical cord blood (CB), or growth-factor-mobilized peripheral blood (PBSC) give rise to progressively more lineage-committed hematopoietic progenitor cells (HPCs), which in turn produce all of the mature blood and immune cells, and probably endothelial cells as well. In humans, most HSCs and HPCs express the CD34 phosphoglycoprotein protein and MRNA. In vivo engrafling HSCs comprise <<1% of the total $CD34^+$ cell population.

Other markers, such as efficient efflux pumping of rhodamine or Hoescht dyes, or CD133, that enrich for primitive hematopoietic stem-progenitor cell (HSPC) subpopulations have also been described, but are much less extensively characterized for human as opposed to mouse HSPCs, with regard to HSC function such as repopulation and engraftment ability (Civin et al., (1996) *J Clin Oncol.,* 14:2224-2233; Larochelle et al., (1996) *Nat Med.,* 2:1329-1337; Krause et al., (1996) *Blood,* 87:1-13; Civin et al., (1984) *J. Immunology,* 133:157-165 and Bhatia et al., (1998) *Nat Med.,* 4:1038-45).

A significant body of work has been reported on the gene expression of mouse HSPCs. For example, initial studies used cDNA/RT-PCR-based subtraction libraries of transcripts expressed in mouse fetal liver (Phillips et al., (2000) *Science,* 288:1635-1640) or BM (Terskikh et al., (2001) *Proc. Natl. Acad. Sci. U.S.A.,* 98:7934-7939) HSPCs, and found hundreds to thousands of transcripts over-represented in HSPCs, as compared to more mature hematopoietic cells. Park et al., ((2002) *Blood,* 99:488-498), using a subtractive microarray approach to compare mouse HSC-enriched Thy1.1loc-kit+ Sca–1hiLin–/lo cells to HPC-enriched populations, found that approximately 5000 cDNA clones were differentially expressed between the two populations. Terskikh et al., ((2001) *Proc. Natl. Acad. Sci. U.S.A.,* 98:7934-7939) used nylon cDNA arrays, containing a limited set of 1,176 genes, to examine gene expression of mouse HSCs, common myeloid, granulocyte-macrophage, megakaryocyte-erythrocyte, and lymphoid progenitors, and pro-B, and pro-T cells. Although this study examined only a handful of genes, the authors showed that a number of hematopoiesis-specific genes were expressed by HSCs. The expression of these genes decreased in progressively more committed HPCs, which at the same time, began to express lineage-specific genes. Akashi et al., ((2003) *Blood,* 101:383-389) performed a similar study with 24,000 gene oligonucleotide arrays. In addition to confirming the prior study, they found that HSCs expressed a number of "non-hematopoietic" genes.

However, due to the difficulties of isolating numbers of highly purified HSC-enriched sub-populations sufficient to produce the quantities of RNA needed for microarray hybridization, to date only a handful of studies have attempted similar gene expression analyses with human HSPCs. Instead, most previous microarray analyses of human HSPCs have had to use relatively unpurified, "total" CD34+ cell preparations (only <<1% of which are HSCs), rather than more highly HSC-enriched subpopulations of CD34+cells. As an example, Steidl et al., ((2002) *Blood,* 99:2037-2044) examined the expression of 1185 genes from BM and PBSC (total) CD34+ cells. They found 65 genes differentially expressed, some of which may explain the higher levels of cell cycling in CD34+ cells from BM, as compared to PBSC. A further example includes a recent investigation that analyzed the total CD34+ cell population by SAGE (Zhou et al. (2001) *Proc. Natl. Acad. Sci.,* 98:13966-13971); myeloperoxidase was one of the genes found to be expressed in total CD34+ cells. However, myeloperoxidase is expressed only in committed phagocytic precursors and phagocytes, not in undifferentiated HSCs. (Wang et al., (2001) *Leukemia* 17:779-786; Friedman et al., (1996) *Curr Top Microbiol Immunol.,* 211:149-157; Friedman et al., (1996) *Leuk Res.,* 20:809-815)

While these studies defined genes expressed in the total CD34+ cell population, these analyses may have missed expression of key human HSC genes or misinterpreted their expression in HSCs versus more mature HPCs. In other words, these studies most likely identified genes expressed principally in HPCs, not HSCs. In addition, only relatively small-scale microarray gene expression analyses have been reported (generally <5000-12,000 known genes), further limiting the impact of these studies of human HSPCs.

Two recent studies have begun to define a general gene expression phenotype for stem cells. Ramalho-Santos et al., ((2002) *Science,* 298:597-600) examined the transcriptomes of "side population" (SP) mouse BM Kit+Lin–Sca–1+HSC-enriched cells, mouse neurospheres, and a mouse embryonic stem cell (ESC) line. Four transcripts were expressed in all three stem cell types, but not in more mature cell types. An additional 212 transcripts were highly enriched in the three types of stem cells, but these genes were also detected in more mature cell types. Ivanova et al., ((2002) *Science,* 298:601-4) examined the transcriptomes of mouse adult BM Kit+Lin–Sca–1+ Rho$^{low}$, mouse fetal liver Kit$^+$Lin$^-$Sca-1$^{+AA}$4.1$^+$, and human fetal liver CD34$^+$/CD38$^-$/Lin$^-$ HSC-enriched cell populations, as well as mouse neurosphere SP cells and a mouse ESC line. 322 transcripts were enriched in all these HSPC populations, and 283 transcripts in all three stem cell types. Interestingly, both these groups found that approximately half of the genes expressed in the stem cell-enriched populations had unknown function or were ESTs. Yet, similar to previous work with HSPCs, these investigations studied mainly mouse cells, examining only one human cell population. In addition, comparison of the lists of stem cell-overexpressed genes from these two studies reveals that only 6 genes were common to both lists (Fortunel et al., (2003) *Science,* 302:393; Evsikov et al., (2003) *Science,* 302:393 and Vogel, G. (2003) *Science,* 302:393).

Accordingly there is still a need for a detailed molecular characterization of highly enriched human hematopoietic stem cells (HSCs) to identify a set of genes that might include candidate regulators involved in the survival, self-renewal, differentiation and/or migration/adhesion capacities of human HSCs, as well as, genes that may be targets in "cancer stem cells" which give rise to blood cancers.

SUMMARY

In one aspect, the invention features a support matrix having attached thereto a polynucleotide of sufficient length to hybridize specifically to a complementary polynucleotide in solution under high stringency hybridization conditions, wherein said polynucleotide has a sequence complementary to a gene selected from the genes listed in Table 1. Such support matrices may have attached thereto a plurality of said polynucleotides. For example, there may be at least 10, 20, 50, or 100 said polynucleotides attached to the support matrix. The polynucleotides may have a sequence complementary to a gene selected from the group consisting of: CD52, KIT, FLT3, GATA-2, GATA-3, p27, HoxA5, HoxA9, CD34, and MDR2. The polynucleotides may also have a sequence complementary to Hepatic Leukemia Factor (HLF) or PPHN cDNA, CEBPB cDNA, GATA-3 cDNA, HoxA3 cDNA, HoxB6 cDNA, hepatopoietic Pbx-interacting protein (HPIP) cDNA, Krupple-like factor 2 (KLF2) cDNA, Krupple-like factor 4 (KLF4) cDNA, myelodysplastic syndrome gene 1 (MDS1) cDNA, NRIP1/RIP140 cDNA or histone cDNA. The polynucleotide may further have a sequence complementary to a gene listed in Table 1, the expression of which is increased at least 2, 5, 10, or 15 fold in CD34+/CD38/Lin– cells over CD34+/CD38+/Lin+ cells in bone marrow, cord blood, mobilized peripheral blood or non-mobilized blood. The polynucleotide may have a sequence complementary to a gene listed in Table 1, said gene having a known or predicted function. The polynucleotide may also have a sequence complementary to a gene listed in Table 1, said gene having a function selected from the group consisting of signaling, transcription, and DNA structure. The polynucleotide may also have a sequence complementary to a gene listed in Table 1, said gene having an unknown function.

In another aspect, the invention also features a support matrix having attached thereto a polynucleotide of sufficient length to hybridize specifically to a complementary polynucleotide in solution under high stringency hybridization conditions, wherein said polynucleotide has a sequence complementary to a gene selected from the list of genes in Table 2. Such support matrices may have attached thereto a plurality of said polynucleotides. For example, there may be at least 10, 20, 50, or 100 said polynucleotides attached to the support matrix. Said polynucleotides may have a sequence complementary to a gene listed in Table 2, the expression of which is decreased at least 2, 5, 10, or 15 fold in CD34+/CD38−/Lin− cells over CD34+/CD38+/Lin+ cells in bone marrow, cord blood, mobilized peripheral blood or non-mobilized blood. Said polynucleotides may have a sequence complementary to a gene listed in Table 2, said gene having a known or predicted function. For example, said gene may have a function selected from the group consisting of signaling, transcription, cell cycle, and protein synthesis. Said gene may have an unknown function.

The invention also features a method of identifying whether a cell suspension comprises hematopoietic stem cells, comprising the steps of: providing a cell suspension of bone marrow, umbilical cord blood, mobilized peripheral blood cells or non-mobilized blood; obtaining mRNA from the cell suspension; assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 1. The method may further comprise the steps of substantially enriching the cell suspension in cells displaying the CD34 antigen on the cell surface; substantially depleting the cell suspension of cells displaying the CD38 antigen on the cell surface; and substantially depleting the cell suspension of cells displaying the Lin antigen on the cell surface. The method may further include carrying out substantially enriching and depleting steps prior to obtaining mRNA from the cell suspension. The assaying step as described in the method may be carried out by contacting said mRNA with a support matrix having said polynucleotide attached thereto. The support matrix may have a plurality of said polynucleotides attached thereto. The method may further include culturing the said cell suspension prior to obtaining mRNA from the cell suspension.

The invention further features a method of determining when a cultured cell suspension derived from bone marrow, cord blood, mobilized peripheral blood or non-mobilized blood has become substantially enriched in hematopoietic stem cells, comprising the steps of obtaining MRNA from the cultured cell suspension; and assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 1, wherein the presence of an mRNA species which hybridizes specifically to said polynucleotide indicates that said cultured cell suspension has become enriched in hematopoietic progenitor cells. The said cultured cell suspension may be substantially enriched in cells displaying the CD34 surface antigen and may also be substantially depleted of cells displaying the CD38 and Lin antigens.

In a another aspect, the invention features a method of reconstituting hematopoiesis in a subject in need thereof, comprising the steps of providing a cultured cell suspension of histocompatible bone marrow, umbilical cord blood, or mobilized peripheral blood cells or non-mobilized blood cells; assaying said cultured cell suspension for the presence of a hematopoietic stem cell MRNA species according to previously described methods and, if said mRNA species is present, administering said cultured cell suspension to the subject in need thereof.

In a further aspect, the invention also provides for a method of determining whether cells having undesired proliferative capacity are present in a subject having leukemia or lymphoma, comprising the steps of: obtaining a tissue sample comprising blood cells from said subject; obtaining mRNA from cells in said tissue sample; assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 1, wherein the presence of an mRNA species which hybridizes specifically to said polynucleotide indicates that said tissue sample comprises cells having undesired proliferative capacity.

The invention further features a method of identifying whether a cell suspension comprises hematopoietic stem cells, comprising the steps of: providing a cell suspension of bone marrow, umbilical cord blood, mobilized peripheral blood cells or non-mobilized blood cells; obtaining mRNA from the cell suspension; assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 1; and assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 2, wherein an enrichment of mRNA species assayed as described and a depletion of mRNA species assayed as described indicates the presence of hematopoietic stem cells in said cell suspension. The method may further comprise the steps of substantially enriching the cell suspension in cells displaying the CD34 antigen on the cell surface; substantially depleting the cell suspension of cells displaying the CD38 antigen on the cell surface; and substantially depleting the cell suspension of cells displaying the Lin antigen on the cell surface. Said substantially enriching and depleting steps may be carried out prior to obtaining mRNA from the cell suspension. Said cell suspension may be cultured prior to obtaining mRNA from the cell suspension.

The invention also features a method of determining when a cultured cell suspension derived from bone marrow, cord blood, mobilized peripheral blood or non-mobilized blood has become substantially enriched in hematopoietic stem cells, comprising the steps of obtaining mRNA from the cultured cell suspension; assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 1; and assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 2, wherein an enrichment of mRNA species assayed as described and a depletion of mRNA species assayed as described indicates the presence of hematopoietic stem cells in said cell suspension.

In a further aspect. the invention features a method of reconstituting hematopoiesis in a subject in need thereof, comprising the steps of providing a cultured suspension of histocompatible bone marrow, umbilical cord blood, mobilized peripheral blood cells or non-mobilized blood cells; assaying said cultured cell suspension for the presence of hematopoietic stem cell mRNA species as described; and, if said mRNA species is present, administering said cultured cell suspension to the subject in need thereof. Said cultured cell suspension may be substantially enriched in cells displaying the CD34 surface antigen or may be substantially depleted of cells displaying the CD38 and Lin antigens.

The invention also features a method of determining whether cells having undesired proliferative capacity are present in a subject having leukemia or lymphoma, comprising the steps of obtaining a tissue sample comprising blood cells from said subject; obtaining mRNA from cells in said tissue sample; assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 1; and assaying said mRNA for the presence of mRNA species which hybridize to a polynucleotide of sufficient length to hybridize specifically to a complementary polynucleotide under high stringency hybridization conditions, wherein said polynucleotide has a sequence complementary to a gene selected from the genes listed in Table 2, wherein an enrichment of mRNA species assayed in step (c) and a depletion of mRNA species assayed in step (d) indicates that said tissue sample comprises cells having undesired proliferative capacity.

In yet another aspect, the invention features a biochip comprising a support matrix having attached thereto a plurality of polynucleotides of sufficient length to hybridize specifically to a complementary polynucleotide in solution under high stringency hybridization conditions, wherein said polynucleotides have sequences complementary to genes selected independently from the genes listed in Table 1. The invention also features a biochip comprising a support matrix having attached thereto a plurality of polynucleotides of sufficient length to hybridize specifically to a complementary polynucleotide in solution under high stringency hybridization conditions, wherein said polynucleotides have sequences complementary to genes selected independently from the genes listed in Table 2.

In another aspect, the invention features an isolated population of cells substantially enriched in hematopoietic stem cells over-expressing mRNA of genes listed in Table 1. The isolated population may further under-express mRNA of genes listed in Table 2. This invention further features a method of making a neural cell comprising culturing a hematopoietic stem cell as described n a media that contains an appropriate amount of a neural cell differentiation factor under appropriate conditions and for a sufficient period of time for the hematopoietic stem cell to differentiate into a neural cell. The invention also features a method of making an endothelial cell comprising culturing a hematopoietic stem cell as described in a media that contains an appropriate amount of a endothelial cell differentiation factor under appropriate conditions and for a sufficient period of time for the hematopoietic stem cell to differentiate into an endothelial cell. The invention further features a method of making a hepatocyte comprising culturing a hematopoietic stem cell as described in a media that contains an appropriate amount of a hepatocyte differentiation factor under appropriate conditions and for a sufficient period of time for the hematopoietic stem cell to differentiate into a hepatocyte. The invention also features a method of making a muscle cell comprising culturing a hematopoietic stem cell as described in a media that contains an appropriate amount of a muscle cell differentiation factor under appropriate conditions and for a sufficient period of time for the hematopoietic stem cell to differentiate into a muscle cell.

Other features and advantages of the invention will be apparent based on the following Detailed Description and Claims.

DETAILED DESCRIPTION

1. General

Figure 1A:
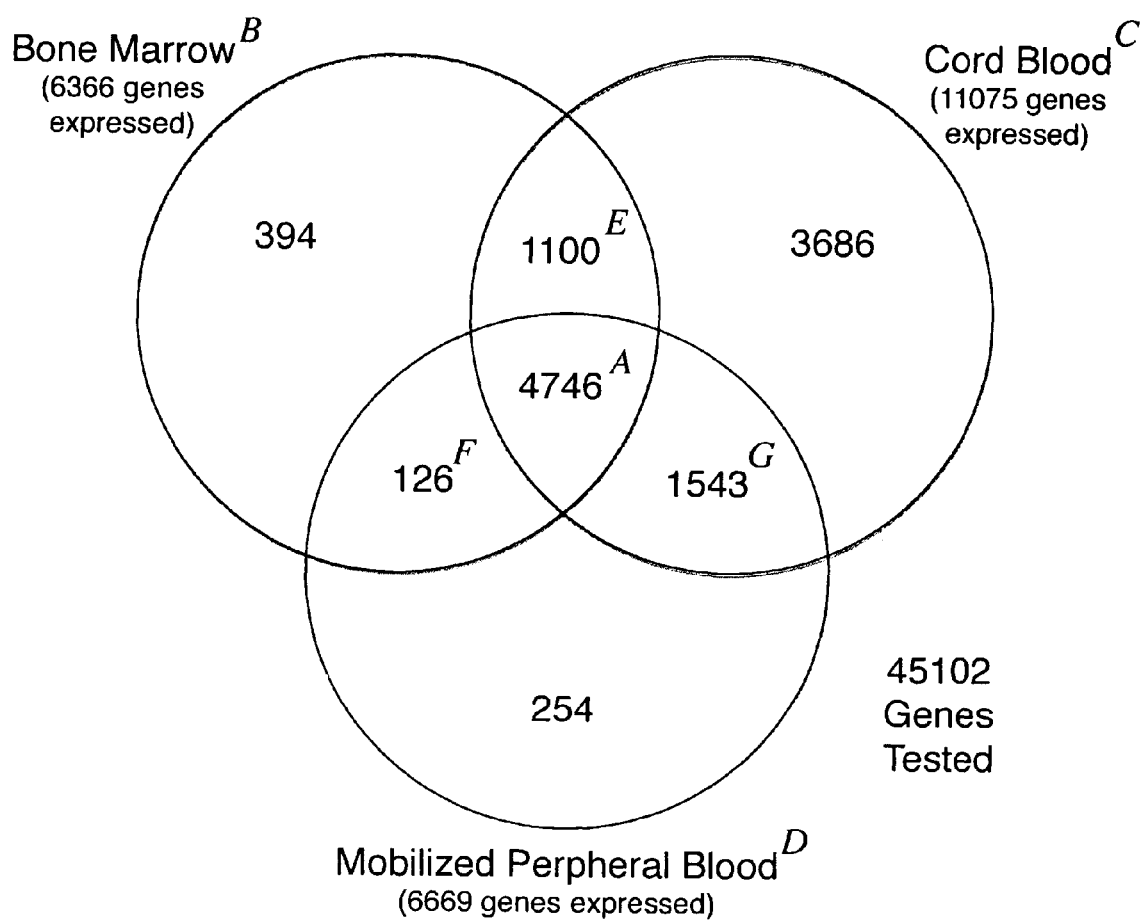
FIG. 1A is a Venn diagram depicting the numbers of genes expressed in BM, CB, and/or PBSC CD34+/CD38−/Lin− populations. Gene expression results from the U133 A and B chips were analyzed with Affymetrix MAS 5.0 software. Only transcripts scored as "Present" (i.e., detectably expressed) in CD34+/CD38−/Lin− cells from both the duplicate samples for each tissue source were included. Shown are transcripts (A) expressed in all three tissues; transcripts expressed in (B) BM, (C) CB, or (D) PBSC; (E) transcripts expressed in BM and CB, (F) in BM and PBSC, or (G) in CB and PBSC.
Figure 1B:
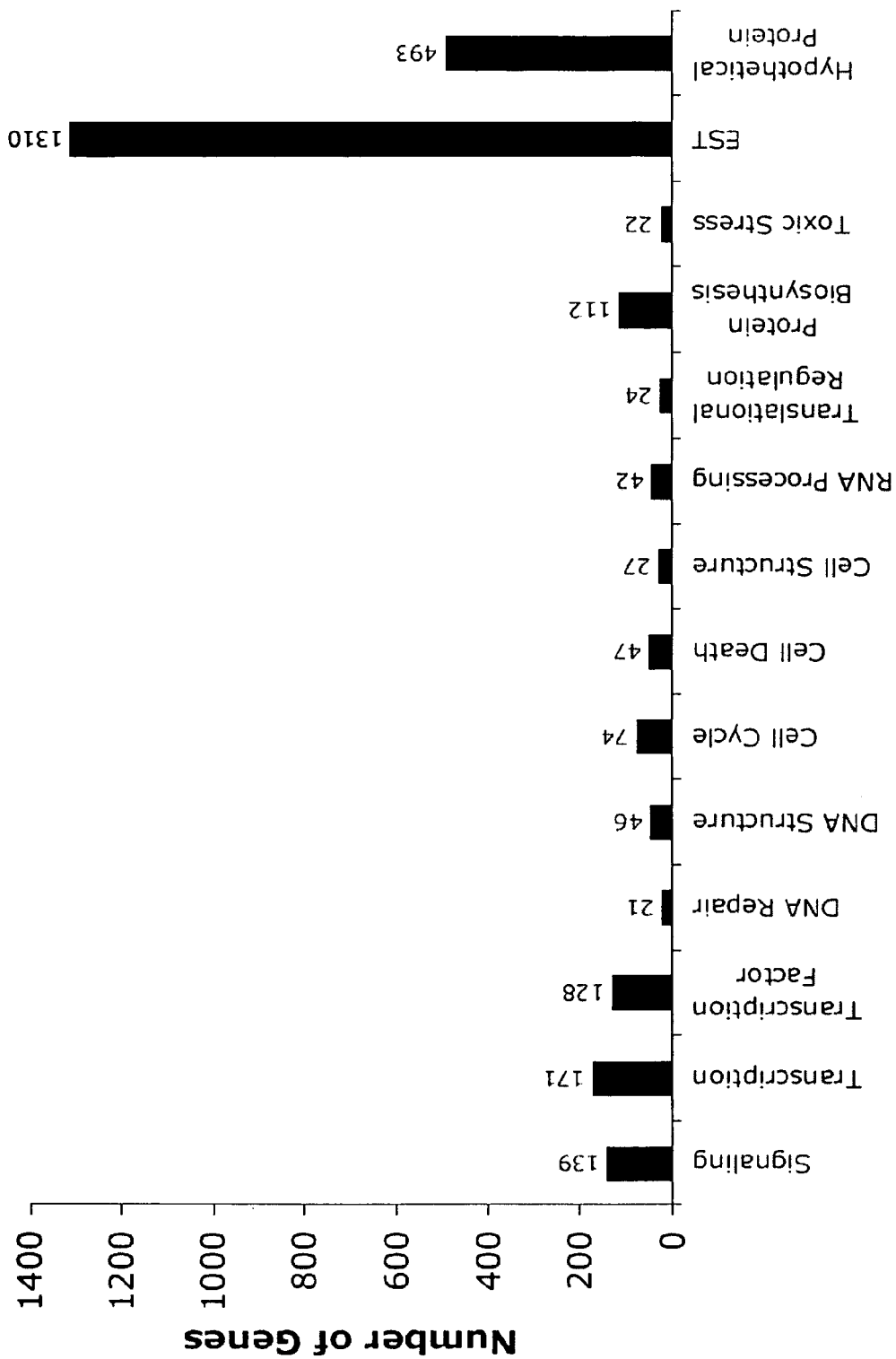
FIG. 1B is a bar graph showing the functional categorization, based on the Gene Ontology (GO) Consortium classification system, of the 4746 common transcripts.

The invention is based at least in part on the discovery of novel groups of genes and/or their encoded gene products that are differentially represented in two highly enriched CD34+/CD38−/Lin− and CD34+/[CD38/Lin]++ hematopoietic cell populations isolated from normal human bone marrow, cord blood, and peripheral blood stem cell preparations. CD34+/CD38−/Lin− cells from each of these tissues are capable of fully reconstituting lympho-hematopoiesis by in vivo engraftment assays whereas CD34+/[CD38/Lin]++ cells are known to be depleted of in vivo engrafting HSCs and enriched in later HPCs.

The novel group of genes and/or their encoded gene products were discovered by comparing the gene expression profiles of the CD34+/CD38−/Lin− HSC-enriched population to those of the complementary CD34+/[CD38/Lin]++ HSC-depleted population from each tissue source via the commercially available Affymetrix U133 A and B gene chips. Both these gene chips contain 45,102 individual genetic targets that include known genes, predicted genes and ESTs. SAGE confirmed expression levels of 94% of the over-represented transcripts. In addition, SAGE detected ~58% more transcripts than the oligonucleotide microarrays, a large proportion of which were expressed only in the HSC-enriched population. This novel group of genes and/or their encoded gene products of genes include candidate regulators involved in the survival, self-renewal, differentiation and/or migration/adhesion capacities of human HSCs, as well as genes that may be targets in "cancer stem cells" which give rise to blood cancers.

The present invention also contemplates gene and/or protein expression profiling based on the novel group of genes and/or their encoded gene products that are over- or under-represented in the CD34+/CD38−/Lin− HSC-enriched populations as compared to CD34+/[CD38/Lin]++ HSC-depleted populations. In a further embodiment, the roles of this novel group of genes and/or their encoded gene products as listed in Table 1 and Table 2 in survival, self-renewal, differentiation and/or migration/adhesion capacities of human HSCs, potential therapeutic targets of blood cancers may be investigated by methods as described below and/or by methods known to persons of skill in the art.

2. Definitions

For convenience, certain terms employed in the specification, examples, and appended claims are collected here. Unless defined otherwise, all technical and scientific terms used herein have the same meaning as commonly understood by one of ordinary skill in the art to which this invention belongs.

The articles "a" and "an" are used herein to refer to one or to more than one (i.e., to at least one) of the grammatical object of the article. By way of example, "an element" means one element or more than one element.

The term "antibody" as used herein is intended to include whole antibodies, e.g., of any isotype (IgG, IgA, IgM, IgE, etc), and includes fragments thereof which are also specifically reactive with a vertebrate, e.g., mammalian, protein. Antibodies can be fragmented using conventional techniques and the fragments screened for utility in the same manner. Thus, the term includes segments of proteolytically-cleaved or recombinantly-prepared portions of an antibody molecule that are capable of selectively reacting with a certain protein. Nonlimiting examples of such proteolytic and/or recombinant fragments include Fab, F(ab')2, Fab', Fv, and single chain antibodies (scFv) containing a V[L] and/or V[H] domain joined by a peptide linker. The scFv's may be covalently or non-covalently linked to form antibodies having two or more binding sites. The subject invention involves the use of polyclonal, monoclonal, humanized, or other purified preparations of antibodies and recombinant antibodies.

"Antisense" nucleic acid refers to oligonucleotides or polynucleotides which specifically hybridize (e.g., bind) under cellular conditions with a gene sequence, such as at the cellular mRNA and/or genomic DNA level, so as to inhibit expression of that gene, e.g., by inhibiting transcription and/or translation. The binding may be by conventional base pair complementarily, or, for example, in the case of binding to DNA duplexes, through specific interactions in the major groove of the double helix.

As used herein, "CD34" refers to a glycoprotein found on immature hematopoietic cells and endothelial cells (Krause et al., (1996) *Blood* 87:1). CD34 may also be known as gp105-120 or as My-10 antigen.

The term "CD38" refers to a cell surface protein expressed on activated T-cells, terminally differentiated B-cells, early B-cells, monocytes, multiple myelomas, most cases of Acute Lymphoblastic leukemia (ALL)(both T and B lineage), and some Acute Myeloid Leukemia (AML). CD38 is a single-chain Type II transmembrane protein and may sometimes be referred to as T10 (Jackson et al., (1990) *J. Immun.* 144: 2811-2815).

"Complementary" or "complementarity", refer to the natural binding of polynucleotides under permissive salt and temperature conditions by base-pairing. For example, the sequence "A-G-T" binds to the complementary sequence "T-C-A". Complementarity between two single-stranded molecules may be "partial", in which only some of the nucleic acids or portions of the nucleic acids bind, or it may be complete or perfect when total complementarity exists between the single stranded molecules. The degree of complementarity between nucleic acid strands has significant effects on the efficiency and strength of hybridization between nucleic acid strands.

"Derived from" as that phrase is used herein indicates a peptide or nucleotide sequence selected from within a reference sequence. A peptide or nucleotide sequence derived from a named sequence may contain a small number of modifications relative to the parent sequence, in most cases representing deletion, replacement or insertion of less than about 15%, preferably less than about 10%, and in many cases less than about 5%, of amino acid residues or base pairs present in the parent sequence. In the case of DNAs, one DNA molecule is also considered to be derived from another if the two are capable of selectively hybridizing to one another.

"Derivative" refers to the chemical modification of a polypeptide sequence, or a polynucleotide sequence. Chemical modifications of a polynucleotide sequence may include, for example, replacement of hydrogen by an alkyl, acyl, or amino group. A derivative polynucleotide encodes a polypeptide which retains at least one biological or immunological function of the natural molecule. A polypeptide derivative is a polypeptide modified by glycosylation, pegylation, or any similar process that retains at least one biological or immunological function of the polypeptide from which it was derived.

"Detection agents of genes" refer to agents that may be used to specifically detect the gene or other biological molecule relating to it, e.g., RNA transcribed from the gene and polypeptides encoded by the gene. Exemplary detection agents are nucleic acid probes, which hybridize to nucleic acids corresponding to the gene, and antibodies.

The term "depleted" or "depleting" as used herein, means that a population of cells comprises a detectably lower level of the depleted cell type than an otherwise identical cell population not subjected to selection against that cell type. The level of depletion may be determined by comparing the number of cells of interest in an unselected population to the number of cells of interest in a population selected for absence of a particular trait or marker by a cell selection method.

"Differentiation" refers to the process by which a cell becomes specialized for a specific structure or function by selective gene expression of some genes and selective repression of others.

"Differential expression" refers to both quantitative as well as qualitative differences in a gene's temporal and/or tissue expression patterns. Differentially expressed genes may represent "target genes". Alternatively, "differential expression" may also refer to both quantitative as well as qualitative differences in a protein's temporal and/or tissue expression patterns.

"Differential gene expression" between cell A and cell B refers to the differences in gene expression between cell A and cell B. A differential gene expression profile may also be obtained between a cell at one time point and a cell at another time point, or between a cell incubated or contacted with a compound and a cell that was not incubated with or contacted with the compound.

An "effective amount" is an amount sufficient to produce a beneficial or desired clinical result upon treatment. An effective amount can be administered to a patient in one or more doses. In terms of treatment, an effective amount is an amount that is sufficient to palliate, ameliorate, stabilize, reverse or slow the progression of the disease, or otherwise reduce the pathological consequences of the disease. The effective amount is generally determined by the physician on a case-by-case basis and is within the skill of one in the art. Several factors are typically taken into account when determining an appropriate dosage to achieve an effective amount. These factors include age, sex and weight of the patient, the condition being treated, the severity of the condition and the form and effective concentration of the agent administered.

By the term "engrafting" or "engraftment" is meant the persistence of proliferating stem cells in a particular location over time in an animal, such as a human. Thus, early repopulating stem cells do not persist for more than about 6 weeks, whereas late repopulating stem cells persist for longer, and preferably much longer, than about 6 weeks.

The term "enriched" or "enriching" as used herein, means that a population of cells comprises a detectably higher level of the enriched cell type than an otherwise identical cell population not subjected to selection for that cell type. The level of enrichment may be determined by comparing the number of cells of interest in an unselected population to the number of cells of interest in a population selected for a particular trait or marker by a cell selection method.

"Equivalent" when used to describe nucleic acids or nucleotide sequences refers to nucleotide sequences encoding functionally equivalent polypeptides. Equivalent nucleotide sequences will include sequences that differ by one or more nucleotide substitutions, additions or deletions, such as allelic variants; and will, therefore, include sequences that differ from the nucleotide sequence of the nucleic acids referred to in the Tables 1 and 2 due to the degeneracy of the genetic code.

"Expression profile" which is used interchangeably herein with "gene expression profile" and "finger print" of a cell, refers to a set of values representing mRNA levels of 20 or more genes in a cell. An expression profile preferably comprises values representing expression levels of at least about 30 genes, preferably at least about 50, 100, 200 or more genes. Expression profiles preferably comprise an mRNA level of a gene which is expressed at similar levels in multiple cells and conditions, e.g., GAPDH. Where indicated the "expression profile" may also include protein expression profile of a cell.

The "profile" of a cell's biological state refers to the levels of various constituents of a cell that are known to change in response to drug treatments and other perturbations of the cell's biological state. Constituents of a cell include levels of RNA, levels of protein abundances, or protein activity levels.

An expression profile in one cell is "similar" to an expression profile in another cell when the level of expression of the genes in the two profiles are sufficiently similar that the similarity is indicative of a common characteristic, e.g., being one and the same type of cell. Accordingly, the expression profiles of a first cell and a second cell are similar when at least 75% of the genes that are expressed in the first cell are expressed in the second cell at a level that is within a factor of two relative to the first cell. The "level of expression of a gene in a cell" or "gene expression level" refers to the level of mRNA, as well as pre-mRNA nascent transcript(s), transcript processing intermediates, mature mRNA(s) and degradation products, encoded by the gene in the cell.

The term "(lympho)-hematopoietic stem cell" is intended to mean a pluripotent cell of the hematopoietic system capable of differentiating into cells of the lymphoid and myeloid lineages. It is also used interchangeably with "the CD34+/CD38−/Lin− substantially enriched hematopoietic stem cells" or "hematopoietic stem cell (HSC)". The term "substantially enriched" is used herein to refer to a solution containing at least two times, three times, four times, ten times, or one hundred times the concentration of HSCs than solutions that have not been selected for the CD34+/CD38−/Lin−phenotype.

The term "substantially depleted" is used herein to refer to a solution that contains a concentration of the CD34+/CD38−/Lin− HSCs that is at least two times, three times, four times, ten times, or one hundred times lower than a solution that has not been selected for cells expressing CD38−/Lin−phenotype.

The term "hematopoieisis" refers to the formation and development of blood cells involving both proliferation and differentiation from stem cells. In adult mammals this usually occurs in the bone marrow.

The term "histocompatible" means being tissue compatible. If a donor and recipient are histocompatible (like identical twins), a transplant will be easily accepted. Histocompatibility is measured by the identification of the major histocompatibility antigens of transplant donors and potential recipients, usually by serological and molecular tests. Donor and recipient pairs should ideally be of identical ABO blood group, and in addition should be matched as closely as possible for histocompatibility antigens in order to minimize the likelihood of allograft rejection.

"Homology" or alternatively "identity" refers to sequence similarity between two peptides or between two nucleic acid molecules. Homology may be determined by comparing a position in each sequence which may be aligned for purposes of comparison. When a position in the compared sequence is occupied by the same base or amino acid, then the molecules are homologous at that position. A degree of homology between sequences is a function of the number of matching or homologous positions shared by the sequences. The term "percent identical" refers to sequence identity between two amino acid sequences or between two nucleotide sequences. Identity may each be determined by comparing a position in each sequence which may be aligned for purposes of comparison. When an equivalent position in the compared sequences is occupied by the same base or amino acid, then the molecules are identical at that position; when the equivalent site occupied by the same or a similar amino acid residue (e.g., similar in steric and/or electronic nature), then the molecules may be referred to as homologous (similar) at that position. Expression as a percentage of homology, similarity, or identity refers to a function of the number of identical or similar amino acids at positions shared by the compared sequences. Various alignment algorithms and/or programs may be used, including FASTA, BLAST, or ENTREZ. FASTA and BLAST are available as a part of the GCG sequence analysis package (University of Wisconsin, Madison, Wis.), and may be used with, e.g., default settings. ENTREZ is available through the National Center for Biotechnology Information, National Library of Medicine, National Institutes of Health, Bethesda, Md. In one embodiment, the percent identity of two sequences may be determined by the GCG program with a gap weight of 1, e.g., each amino acid gap is weighted as if it were a single amino acid or nucleotide mismatch between the two sequences.

Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, Calif., USA. Preferably, an alignment program that permits gaps in the sequence is utilized to align the sequences. The Smith-Waterman is one type of algorithm that permits gaps in sequence alignments. See *Meth. Mol. Biol.* 70: 173-187 (1997). Also, the GAP program using the Needleman and Wunsch alignment method may be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences may be used to search both protein and DNA databases. Databases with individual sequences are described in Methods in Enzymology, ed. Doolittle, supra. Databases include Genbank, EMBL, and DNA Database of Japan (DDBJ).

"Hybridization" refers to any process by which a strand of nucleic acid binds with a complementary strand through nucleotide base pairing, preferably Watson-Crick base pairing.

"Specific hybridization" or "selective hybridization" of a probe to a target site of a template nucleic acid refers to hybridization of the probe predominantly to the target, such that the hybridization signal may be clearly interpreted. As further described herein, such conditions resulting in specific hybridization vary depending on the length of the region of homology, the GC content of the region, the melting temperature "Tm" of the hybrid. Hybridization conditions will thus vary in the salt content, acidity, and temperature of the hybridization solution and the washes.

As used herein, the term "hybridize specifically" or "hybridize selectively" refers to the ability of a nucleic acid molecule to hybridize to at least approximately 6, 12, 20, 30, 50, 100, 150, 200, 300, 350, 400 or 425 or more consecutive complementary nucleotides of a vertebrate gene.

"Interact" is meant to include detectable interactions between molecules, such as may be detected using, for example, a hybridization assay. Interact also includes "binding" interactions between molecules. Interactions may be, for example, protein-protein, protein-nucleic acid, protein-small molecule or small molecule-nucleic acid in nature.

"Isolated" with respect to nucleic acids, such as DNA or RNA, refers to molecules separated from other DNAs, or RNAs, respectively, that are present in the natural source of the macromolecule. Isolated also refers to a nucleic acid or peptide that is substantially free of cellular material, viral material, or culture medium when produced by recombinant DNA techniques, or chemical precursors or other chemicals when chemically synthesized. Moreover, an "isolated nucleic acid" is meant to include nucleic acid fragments which are not naturally occurring as fragments and would not be found in the natural state. "Isolated" also refers to polypeptides which are isolated from other cellular proteins and is meant to encompass both purified and recombinant polypeptides.

"Label" and "detectable label" refer to a molecule capable of detection including, but not limited to radioactive isotopes, fluorophores, chemiluminescent moieties, enzymes, enzyme substrates, enzyme cofactors, enzyme inhibitors, dyes, metal ions, ligands (e.g., biotin or haptens) and the like. "Fluorophore" refers to a substance or a portion thereof which is capable of exhibiting fluorescence in the detectable range. Particular examples of labels which may be used under the invention include fluorescein, rhodamine, dansyl, umbelliferone, Texas red, luminol, NADPH, alpha—beta -galactosidase and horseradish peroxidase.

The term "leukemia" refers to an acute or chronic disease of unknown cause in man and other warm blooded animals that involves developing cells of the blood-immune system. Leukemia is characterized by an abnormal increase in the number of leucocytes in the tissues of the body with or without a corresponding increase of those in the circulating blood and is classified according of the type leucocyte most prominently involved. Leukemias were originally termed acute or chronic based on life expectancy but now are classified according to cellular maturity. Acute leukemias consist of predominantly immature cells (usually blast forms); chronic leukemias, more mature cells. Acute leukemias are divided into lymphoblastic (ALL) and myelogenous (AML) types, which may be further subdivided by morphologic and cytochemical appearance according to the French-American-British (FAB) classification or immunophenotype. The specific B-cell and T-cell and myeloid-antigen monoclonal antibodies, together with flow cytometry, are very helpful for classifying ALL versus AML, which is critical for treatment. Chronic leukemias are described as lymphocytic (CLL) or myelocytic (CML).

As used herein, "blast cells" or "blasts" refers to an immature cell of a proliferative compartment in a cell lineage that normally represent up to 5% of the cells in the bone marrow. An over-production of blasts in the marrow is characteristic of leukaemia when the blast cells often spill out into the blood stream.

The term "Lin" as used herein refers to lineage markers expressed in differentiated cells such as CD3 (T lymphoid cells), CD5 (T lymphoid cells), CD10 (lymphoid progenitor cells), CD13 (mature and progenitor-precursor macrophage/monocytic and granulocytic cells), CD14 (monocyte/macrophages), CD16 (granulocytes, NK cells, monocyte/macrophages), CD19 (mature and early B lymphoid cells), CD33 (mature and progenitor-precursor macrophage/monocytic and granulocytic cells), CD41a (mature and progenitor-precursor platelets, megakaryocytic cells), CD45RA (B lymphoid cells, some T lymphoid cells, some mono/granulocytic progenitor-precursor cells), CD66B (granulocytic cells), CD71 (erythroid progenitor-precursor cells, activated lymphoid cells), and CD235a (glycophorin A; mature and precursor erythroid cells). "Lin$^-$" refers to cells that lack significant amounts of all of the above Lin markers. Conversely, "Lin$^{++}$" refers to cells that express high levels of one or more of the above Lin markers, for example levels sufficient to produce a bright fluorescence signal when detected with a standard fluorescent immunoconjugate.

The term "lymphoma" refers to a malignant tumor of lymphoid cells, usually derived from relatively mature B or T lymphocytes. Two major types are Hodgkin's disease and non-Hodgkin's lymphoma. An example of an uncommon type is mycosis fungoides.

As used herein, "common lymphoid progenitor cells" refers to cells that are capable of differentiating into lymphocytes (T-cells and B-cells), but not myeloid cell types.

The term "mobilized peripheral blood stem-progenitor cell" or "mobilized PBSC" is used herein to refer the cells that are stimulated to leave bone marrow and enter the bloodstream after exposing the host to stimulatory agents, such as filgrastim.

The term "non-mobilized blood cell" is used herein to refer to cells that have not been stimulated with stimulatory agents, such as filgrastim.

"Nucleic acid" refers to polynucleotides such as deoxyribonucleic acid (DNA), and, where appropriate, ribonucleic acid (RNA). The term should also be understood to include, as equivalents, analogs of either RNA or DNA made from nucleotide analogs, and, as applicable to the embodiment being described, single (sense or antisense) and double-stranded polynucleotides. ESTs, chromosomes, cDNAs, mRNAs, and rRNAs are representative examples of molecules that may be referred to as nucleic acids.

"Nucleic acid corresponding to a gene" refers to a nucleic acid that may be used for detecting the gene, e.g., a nucleic acid which is capable of hybridizing specifically to the gene.

"Nucleic acid sample derived from RNA" refers to one or more nucleic acid molecule, e.g., RNA or DNA, that was synthesized from the RNA, and includes DNA resulting from methods using PCR, e.g., RT-PCR.

A "patient", "subject" or "host" may mean any mammal, but preferably a human.

"Percent identical" refers to sequence identity between two amino acid sequences or between two nucleotide sequences. Identity may in each case be determined by comparing a position in each sequence which may be aligned for purposes of comparison. When an equivalent position in the compared sequences is occupied by the same base or amino acid, then the molecules are identical at that position; when the equivalent site occupied by the same or a similar amino acid residue (e.g., similar in steric and/or electronic nature), then the molecules may be referred to as homologous (similar) at that position. Expression as a percentage of homology, similarity, or identity refers to a function of the number of identical or similar amino acids at positions shared by the compared sequences. Various alignment algorithms and/or programs may be used, including FASTA, BLAST, or ENTREZ. FASTA and BLAST are available as a part of the GCG sequence analysis package (University of Wisconsin, Madison, Wis.), and may be used with, e.g., default settings. ENTREZ is available through the National Center for Biotechnology Information, National Library of Medicine, National Institutes of Health, Bethesda, Md. In one embodiment, the percent identity of two sequences may be determined by the GCG program with a gap weight of 1, e.g., each amino acid gap is weighted as if it were a single amino acid or nucleotide mismatch between the two sequences. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, Calif., USA. Preferably, an alignment program that permits gaps in the sequence is utilized to align the sequences. The Smith-Waterman is one type of algorithm that permits gaps in sequence alignments. See *Meth. Mol. Biol.* 70: 173-187 (1997). Also, the GAP program using the Needleman and Wunsch alignment method may be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences may be used to search both protein and DNA databases. Databases with individual sequences are described in Methods in Enzymology, ed. Doolittle, supra. Databases include Genbank, EMBL, and DNA Database of Japan (DDBJ).

"Perfectly matched" in reference to a nucleic acid duplex means that the poly- or oligonucleotide strands making up the duplex form a double stranded structure with one other such that every nucleotide in each strand undergoes Watson-Crick basepairing with a nucleotide in the other strand. The term also comprehends the pairing of nucleoside analogs, such as deoxyinosine, nucleosides with 2-aminopurine bases, and the like, that may be employed. A mismatch in a duplex between a target polynucleotide and an oligonucleotide or olynucleotide means that a pair of nucleotides in the duplex fails to undergo Watson-Crick bonding. In reference to a triplex, the term means that the triplex consists of a perfectly matched duplex and a third strand in which every nucleotide undergoes Hoogsteen or reverse Hoogsteen association with a basepair of the perfectly matched duplex.

The terms "polynucleotide", and "nucleic acid" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. The term "recombinant" polynucleotide means a polynucleotide of genomic, cDNA, semisynthetic, or synthetic origin which either does not occur in nature or is linked to another polynucleotide in a nonnatural arrangement. An "oligonucleotide" refers to a single stranded polynucleotide having less than about 100 nucleotides, less than about, e.g. 75, 50, 25, or 10 nucleotides.

The term "probe" as used herein refers to the tethered nucleic acid or polynucleotide on a support matrix that has a known sequence.

The term "progenitor cells" used herein refers to cells which are the immediate precursors of the differentiating cells. Most of the progenitor cells differentiate along a single lineage but they may have quite extensive proliferative capacity. Progenitor cells appear morphologically as blast cells, and they typically do not have specific features of the hematopoietic lineage to which they are committed.

"Proliferating" and "proliferation" refer to cells undergoing mitosis.

"Protein", "polypeptide" and "peptide" are used interchangeably herein when referring to a gene product, e.g., as may be encoded by a coding sequence. By "gene product" it is meant a molecule that is produced as a result of transcription of a gene. Gene products include RNA molecules transcribed from a gene, as well as proteins translated from such transcripts.

The term "stem cells" used herein refers to the cells from which progenitor cells are derived. Stem cells are defined by their ability to self-renew as well as to generate daughter cells of any of the hematopoietic lineages. Stem cells with long term hematopoietic reconstituting ability can be distinguished by a number of physical and biological properties from differentiated cells and progenitor cells (Hodgson et al., (1979) *Nature* 281:381-382; Visser et al., (1984) *J. Exp. Med.*, 59:1576-1590; Spangrude et al., (1988) *Science*, 241:58-62; Szilvassy et al., (1989) *Blood* 74:930-939; Ploemacher et al., (1989) *Exp. Hematol.*, 17:263-266).

"Support matrix" refers to an arrangement of addressable locations or "addresses" on a device. "Support matrix" may be used interchangeably with the term "microarray". An "address" on a support matrix or an array, e.g., a microarray, refers to a location at which an element, e.g., a polynucleotide of sufficient length or a oligonucletotide, is attached to the solid surface of the array. As used herein, a nucleic acid, polynucleotide or other molecule attached to an array, is referred to as a "probe" or "capture probe". When an array contains several probes corresponding to one gene, these probes are referred to as "gene-probe set." A gene-probe set may consist of, e.g., 2 to 10 probes, preferably from 2 to 5 probes and most preferably about 5 probes.

The locations may be arranged in two dimensional arrays, three dimensional arrays, or other matrix formats. The number of locations may range from several to at least hundreds of thousands. Most importantly, each location represents a totally independent reaction site. A "nucleic acid array" refers to an array containing nucleic acid probes, such as oligonucleotides or polynucleotides of sufficient length. The nucleic acid on the array is preferably single stranded. Arrays wherein the probes are oligonucleotides are referred to as "oligonucelotide arrays" or "oligonucleotide chips" or "gene chips". A "biochip", also referred to as a "chip", "microchip", or "biological chip", is an array of regions having a density of discrete regions of at least $100/cm^2$, and preferably at least about $1000/cm^2$. The addresses in a microarray have typical dimensions, e.g. diameters, in the range of between about 10-250 microns, and are separated from other addresses in the array by the same distance.

As used herein "target" is the free nucleic acid/RNA sample whose identity/abundance is being detected.

The term "transcriptome" is used herein to encompass a profile activated genes, mRNAs, or transcripts in a particular tissue at a particular time. The profile of activated genes, mRNA or transcripts may be a complete set of genes or a subset of the genes expressed in a particular cell. The transcriptome composition strongly varies depending on different environmental conditions. For example, physical stress factors like a rapid increase in environmental temperature also initiate fast and extensive re-organization of gene expression, again resulting in a specific transcriptome. Consequently, transcriptome analyses (transcriptomics) allows a description of expression state of a cell under defined conditions.

The term "treating" or "treatment" as used herein encompasses all detectable beneficial effects on a disorder or disease. Beneficial effects that can be detected clinically by a physician's assessment or through the use of clinical laboratory tests are preferred. The beneficial effects can impact on one or more signs or symptoms of a disorder or disease, or on biological, metabolic, inflammatory or pathological processes arising from or producing the disease or disorders. Preferred beneficial effects include curing as well as ameliorating at least one sign or symptom of the condition or disease, by which is meant that manifestations of that sign or symptom are partially up to completely restored to the normal physiological state.

All publications and patents mentioned herein are hereby incorporated by reference in their entirety as if each individual publication or patent was specifically and individually indicated to be incorporated by reference. In case of conflict, the present application, including any definitions herein, will control.

The practice of the present invention will employ, unless otherwise indicated, conventional techniques of virology, protein chemistry, cell biology, cell culture, molecular biology, microbiology, and recombinant DNA, which are within the skill of the art. Such techniques are explained fully in the literature. See, for example, *Clinical Virology*, $2^{nd}$ Ed., by Richman, Whitley, Hayden (American Society for Microbiology Press: 2002), *Molecular Cloning A Laboratory*

*Manual,* 2nd Ed., ed. by Sambrook, Fritsch and Maniatis (Cold Spring Harbor Laboratory Press: 1989); *DNA Cloning,* Volumes I and II (D. N. Glover ed., 1985); *Oligonucleotide Synthesis* (M. J. Gait ed., 1984); Mullis et al., U.S. Pat. No: 4,683,195; *Nucleic Acid Hybridization* (B. D. Hames & S. J. Higgins eds. 1984); *Transcription And Translation* (B. D. Hames & S. J. Higgins eds. 1984); *Culture Of Animal Cells* (R. I. Freshney, Alan R. Liss, Inc., 1987); *Immobilized Cells And Enzymes* (IRL Press, 1986); B. Perbal, *A Practical Guide To Molecular Cloning* (1984); the treatise, *Methods In Enzymology* (Academic Press, Inc., N.Y.); *Gene Transfer Vectors For Mammalian Cells* (J. H. Miller and M. P. Calos eds., 1987, Cold Spring Harbor Laboratory); and *Methods In Enzymology,* Vols. 154 and 155 (Wu et al., eds.). Cell sorting and cell analysis methods are known in the art and are described in, for example, The *Handbook of Experimental Immunology,* Volumes 1 to 4, (D. N. Weir, editor) and *Flow Cytometry and Cell Sorting* (A. Radbruch, editor, Springer Verlag, 1992).

3. Hematopoietic Stem Cell Isolation and Culture Methods Thereof

Methods for isolating and manipulating bone marrow cells, including hematopoietic stem or progenitor cells, from a bone marrow graft donor are known in the art. For example, U.S. Pat. Nos. 4,965,204, 5,035,994, 5,081,030, 5,130,144, 5,137,809, 6,068,836 and 6,200,606, the contents of which patents are hereby incorporated by reference, describe methods for obtaining and manipulating bone marrow stem cells from a mammalian bone marrow donor. In general, methods of isolating stem cells and progenitor cells include isolation from other cells in hematopoietic tissue of the body and particularly bone marrow. Stem cells and progenitor cells from bone marrow constitute only a small percentage of the total number of hematopoietic cells. Stem cells appear to be in the range of about 0.001 to about 0.01% of the bone marrow cells. Bone marrow cells may be obtained from ilium, sternum, tibiae, femora spine and other bone cavities. Other non-limiting sources of hematopoietic stem cells include embryonic yolk sac, fetal liver, fetal and adult spleen, blood including adult peripheral blood and umbilical cord blood (To et al., (1997) *Blood* 89:2233-2258).

For the isolation of bone marrow, especially from mouse, an appropriate solution may be used to flush the bone, including but not limited to salt solution, supplemented with fetal calf serum or other naturally occurring factors in conjunction with an acceptable buffer at low concentration, generally about 5 to 25 mM. Buffers include but are not limited to HEPES, phosphate and lactate buffers. Bone marrow can also be aspirated from the bone, especially human bone, in accordance with conventional techniques.

One of the most useful differentiation antigens for isolating human hematopoietic stem-progenitor cells is the cell surface antigen known as CD34. CD34 is expressed by about 1% to 5% of normal human adult marrow cells in a developmentally, stage-specific manner (Civin et al., (1984) *J. Immunol,* 133:157-165). $CD34^+$ cells are a mixture of immature blastic cells and a small percentage of mature, lineage-committed cells of the myeloid, erythroid and lymphoid series. Perhaps 1% of $CD34^+$ cells are pluripotent HSCs with the remaining number being progenitor cells committed to a particular lineage(s). Results in humans have demonstrated that $CD34^+$ cells isolated from marrow or other hematopoietic sources such as mobilized peripheral blood can reconstitute the entire lympho-hematopoietic system for a lifetime. Therefore, CD34 is a marker for HSCs and hematopoietic progenitor cells. In a further embodiment, cells may be further enriched for hematopoietic stem cells by negative selection using CD38 marker and the following lineage markers (collectively known as Lin markers): CD3 (expressed on T lymphoid cells), CD5 (expressed on T lymphoid cells), CD10 (expressed on lymphoid progenitor cells), CD13 (expressed on mature and progenitor-precursor macrophage/monocytic and granulocytic cells), CD14 (expressed on monocyte/macrophages), CD16 (expressed on granulocytes, natural killer cells, monocyte/macrophages), CD19 (expressed on mature and early B lymphoid cells), CD33 (expressed on mature and progenitor-precursor macrophage/monocytic and granulocytic cells), CD41a (expressed on mature and progenitor-precursor platelets, megakaryocytic cells), CD45RA (expressed on B lymphoid cells, some T lymphoid cells, some mono/granulocytic progenitor-precursor cells), CD66B (expressed on granulocytic cells), CD71 (expressed on erythroid progenitor-precursor cells, activated lymphoid cells), and glycophorin A (also known as CD235A, expressed on erythrocytes).

The combination of expression markers used to isolate and define a substantially enriched HSC population may vary depending on other various factors and may vary as with the identification of other expression markers as described herein.

Other procedures may be employed to separate hematopoietic stem cells from other cells and these procedures include physical separation, magnetic separation using antibody-coated magnetic beads, affinity chromatography, and cytotoxic agents joined to a monoclonal antibody or used in conjunction with a monoclonal antibody. Also included is the use of fluorescence activated cell sorters (FACS) wherein the cells can be separated on the basis of the level of staining of the particular antigens. These techniques are well known to those of ordinary skill in the art and are described in various references including U.S. Pat. Nos. 5,061,620; 5,409,8213; 5,677,136; and 5,750,397; and Yau et al., (1990) *Exp. Hematol.,* 18:219-222.

During positive selection of stem cells, unbound cells may be eluted or washed away with physiologic buffer after allowing sufficient time for the stem cells to be bound. The unbound marrow cells can be recovered and used for other purposes or discarded after appropriate testing has been done to ensure that the desired separation had been achieved. The bound cells are then separated from the solid phase by any appropriate method, depending mainly upon the nature of the solid phase and the antibody. For example, bound cells can be eluted from a plastic petri dish by vigorous agitation. Alternatively, bound cells can be eluted by enzymatically "nicking" or digesting a enzyme-sensitive "spacer" sequence between the solid phase and the antibody. Spacers bound to agarose beads are commercially available from, for example, Pharmacia. Another alternative is to competitively elute the bound cells from the column using a peptide which binds the antibody that is attached to the solid phase of the column.

The eluted, substantially enriched fraction of cells may then be washed with a buffer by centrifugation and either cryopreserved in a viable state for later use according to conventional technology or immediately infused intravenously into the transplant recipient following appropriate testing to ensure that the desired separation of a purified population of stem cells has been achieved.

In another embodiment of the invention, neonatal hematopoietic stem and progenitor cells can be obtained from placental/umbilical cord blood ("cord blood"). The use of cord blood as a source of cells to repopulate the hematopoietic system provides numerous advantages. Cord blood can be obtained easily and without trauma to the donor. Cord blood cells can be used for autologous transplantation, when and if needed, and the usual hematological and immunological problems associated with the use of allogeneic cells, matched only partially at the major histocompatibility complex or matched fully at the major, but only partially at the minor complexes, are alleviated. Collections should be made under sterile conditions. The neonatal blood can preferably be obtained by direct drainage from the cord and/or by needle aspiration from the delivered placenta at the root and at distended veins (see U.S. Pat. Nos. 5,004,681 and 5,192,553). Alternatively, fetal blood can be obtained, e.g., by taking it from the fetal circulation at the placental root with the use of a needle guided by ultrasound (Daffos et al., (1985) *Am. J Obstet. Gynecol.*, 153:655-660; Daffos et al., (1983) *Am. J. Obstet, Gynecol.*, 146:985), by placentocentesis (Valenti (1973) *Am. J Obstet. Gynecol.*, 115:851; Cao et al., (1982) *J. Med. Genet.*, 19:81), by fetoscopy (Rodeck, C. H. (1984) in *Prenatal Diagnosis*, Rodeck, C. H. and Nicolaides, K. H., eds., Royal College of Obstetricians and Gynaecologists, London).

Immediately upon collection, the cord (or fetal) blood may be mixed with an anticoagulent. Such an anti-coagulant can be any known in the art, including but not limited to CPD (citrate-phosphate-dextrose), ACD (acid itrate-dextrose), Alsever's solution (Alsever et al., (1941) N. Y. St. J. Med. 41:126), De Gowin's Solution (De Gowin et al., (1940) *J. Am. Med. Ass.*, 114:850), Edglugate-Mg (Smith et al., (1959) *J. Thorac. Cardiovasc. Surg.*, 38:573), Rous-Turner Solution (Rous and Turner. (1916) *J. Exp. Med.*, 23:219), other glucose mixtures, heparin, ethyl biscoumacetate, etc. (See Hurn, B. A. L. (1968) *Storage of Blood*, Academic Press, New York, pp. 26-160).

The above methods of treating marrow or blood cell suspensions produce a suspension of human cells that contains pluripotent lympho-hematopoietic stem cells that are substantially free of mature lymphoid and myeloid cells. The cell suspension also contains substantially only cells that express the My-10 antigen (CD34) and can restore the production of lymphoid and hematopoietic cells to a human patient who has lost the ability to produce such cells because of, for example, radiation treatment. By definition, a cell population that can restore the production of hematopoietic and lymphoid cells contains pluripotent "lympho-hematopoietic stem cells".

Hematopoietic stem cells may potentially be multiplied in culture, before or after cryopreservation, thus expanding the number of stem cells available for therapy. Once the hematopoietic stem cells are harvested and optionally separated, the cells may be cultured in a suitable medium comprising a combination of growth factors that are sufficient to maintain growth. The term "culturing" refers to the propagation of cells on or in media of various kinds. It is understood that the descendants of a cell grown in culture may not be completely identical (either morphologically, genetically or phenotypically) to the parent cell. Methods for culturing stem cells and hematopoietic cells are well known to those skilled in the art, and some of these methods are briefly mentioned herein. Any suitable culture container may be used, and these are readily available from commercial vendors. The seeding level is not critical, and it will depend on the type of cells used. In general, the seeding level will be at least 10 cells per ml, more usually at least about 100 cells per ml and generally not more than 106 cells per ml.

Various culture media can be used and non-limiting examples include Iscove's modified Dulbecco's medium (IMDM), X-vivo 15 and RPMI-1640. These are commercially available from various vendors. The formulations may be supplemented with a variety of different nutrients, growth factors, such as cytokines and the like. In general, the term cytokine refers to any one of the numerous factors that exert a variety of effects on cells, such as inducing growth and proliferation. The cytokines may be human in origin or may be derived from other species when active on the cells of interest. Included within the scope of the definition are molecules having similar biological activity to wild type or purified cytokines, for example produced by recombinant means, and molecules which bind to a cytokine factor receptor and which elicit a similar cellular response as the native cytokine factor.

The medium can be serum free or supplemented with suitable amounts of serum such as fetal calf serum, autologous serum or plasma. If cells or cellular products are to be used in humans, the medium will preferably be serum free or supplemented with autologous serum or plasma. (Lansdorp et al., (1992) *J. Exp. Med.* 175:1501 and Petzer et al., (1996) *Proc. Natl. Acad. Sci.*, 93:1470 ).

Non-limiting examples of compounds which may be used to supplement the culture medium are thrombopoietin (TPO), Flt3 ligand (FL), c-kit ligand (KL, also known as stem cell factor (SCF) or St1), Interleukin (IL) such as, IL-1, IL-2, IL-3, IL-6, (soluble IL-6 receptor), IL-11, and IL-12, granulocyte-colony stimulating factor (G-CSF), granulocyte macrophage-colony stimulating factor (GM-CSF), leukemia inhibitory factor (LIF), MIP-1 alpha, and erythropoietin (EPO). These compounds may be used alone or in any combination, and preferred concentration ranges may be readily determined from the published art. When murine stem cells are cultured, a preferred non-limiting medium includes mIL-3, mIL-6 and mSCF.

One skilled in the art is aware of the concentration range of these compounds in cultures. While not meant to limit the invention, a general preferred range of TPO is from about 0.1 ng/mL to about 500.mu.g/mL, more preferred is from about 1.0 ng/mL to about 1000 ng/mL even more preferred is from about 5.0 ng/mL to about 300 ng/mL. A preferred concentration range for each of FL and KL is from about 0.1 ng/mL to about 1000 ng/mL, more preferred is from about 1.0 ng/mL to about 500 ng/mL. IL-6 is a preferred factor to be included in the culture, and a preferred concentration range is from about 0.1 ng/mL to about 500 ng/mL and more preferred in from about 1.0 ng/mL to about 100 ng/mL. Hyper IL-6, a covalent complex of IL-6 and IL-6 receptor may also be used in the culture.

Other molecules can be added to the culture media, for instance, adhesion molecules, such as fibronection or RetroNectin™(commercially produced by Takara Shuzo Co., Otsu Shigi, Japan). The term "fibronectin" refers to a glycoprotein that is found throughout the body, and its concentration is particularly high in connective tissues where it forms a complex with collagen.

4. Genes and Gene Products

The novel group of genes and/or their encoded gene products exhibiting differential expression in the CD34$^+$/CD38$^-$/Lin$^-$ HSC-substantially enriched population as compared to the complementary CD34$^+$/[CD38/Lin]$^{++}$ HSC-depleted population comprise genes involved in the following biological processes: signaling, transcription, DNA repair, DNA structure, cell cycle, cell death, cell structure, RNA processing, translational regulation, protein biosynthesis, toxic stress, ubiquitination, trafficking. Several genes comprise ESTs and hypothetical proteins.

In one embodiment, the genes that are over-represented in the CD34$^+$/CD38$^-$/Lin$^-$ HSC-substantially enriched population as compared to the CD34$^+$/CD38$^+$/Lin$^+$ HSC-depleted population are as listed in Table 1, and probes for gene probe sets for these genes may be attached to a support matrix. In other embodiments, the genes that are under-represented in the CD34+/CD38−/Lin− HSC-substantially enriched population as compared to the CD34+/CD38+/Lin+ HSC-depleted population are as listed in Table 2, and probes for gene probe sets for these genes may be attached to a support matrix. Gene products (for example mRNAs and proteins) of genes listed in Tables 1 and/or 2, or fragments of such gene products (e.g. oligoribonucleotides or peptides) may also be attached to a support matrix. The support matrices of the invention may also comprise of sets of genes that are contemplated for use in the therapeutic, diagnostic and screening methods as described herein.

5. Compositions Comprising Probes Derived from Differentially Expressed Genes of the Invention The present invention provides compositions comprised of support matrices of polynucleotides (hereinafter referred to as "probes") derived from the sequences of the genes reported herein. These compositions are contemplated for use in diagnostic and/or therapeutic applications as discussed herein. Preferred compositions for use according to the invention include one or more polynucleotide sequences of genes whose expression is up-regulated/over-represented in the CD34+/CD38−/Lin− HSC-substantially enriched population as listed in Table 1. In certain embodiments, the support matrices are comprised of polynucleotide sequences selected from the genes listed in Table 2, whose expression is down-regulated/under-represented in the CD34+/CD38−/Lin− HSC-substantially enriched population. The composition may comprise polynucleotides corresponding to at least 10, preferably at least 20, at least 50, or at least 100 genes that are differentially expressed in said in vivo engrafting hematopoietic stem cells. The composition may comprise polynucleotides corresponding to each gene listed in Table 1 or 2, or subsets of those genes in Tables 1 or 2 which are up-regulated or down-regulated in the CD34+/CD38−/Lin− HSC-substantially enriched populations.

In one embodiment, the invention provides a composition comprising a plurality of detection agents for detecting expression of genes in Tables 1 and 2. In a preferred embodiment, the composition comprises at least 2, preferably at least 3, 5, 10, 20, 50, or 100 different detection agents. A detection agent may be a nucleic acid probe, e.g., DNA or RNA, or it may be a polypeptide, e.g., as antibody that binds to the polypeptide encoded by a gene listed in Tables 1 or 2. The probes may be present in equal amount or in different amounts in the composition.

A nucleic acid probe may be at least about 10 nucleotides long, preferably at least about 15, 20, 25, 30, 50, 100 nucleotides or more, and may comprise the full length gene. Preferred probes are those that hybridize specifically to genes listed in Tables 1 or 2. If the nucleic acid is short (i.e., 20 nucleotides or less), the sequence is preferably perfectly complementary to the target gene (i.e., a gene differentially expressed in a the CD34+/CD38−/Lin− hematopoietic stem cell), such that specific hybridization may be obtained. However, nucleic acids, even short ones, that are not perfectly complementary to the target gene may also be included in a composition of the invention, e.g., for use as a negative control. Certain compositions may also comprise nucleic acids that are complementary to, and capable of detecting, an allele of a gene.

In a preferred embodiment, the invention provides nucleic acids which hybridize under high stringency conditions of 0.2 to 1×SSC at 65° C. followed by a wash at 0.2×SSC at 65° C. to genes that are differentially expressed in hematopoietic stem cells. In another embodiment, the invention provides nucleic acids which hybridize under low stringency conditions of 6×SSC at room temperature followed by a wash under moderate stringency of 2×SSC at room temperature. Other nucleic acid probes hybridize to their target under moderate stringency conditions of 3×SSC at 40 or 50° C., followed by a wash under high stringency conditions of 1×SSC or moderate stringency conditions of 2×SSC at 20, 30, 40, 50, 60, or 65° C.

Nucleic acids which are at least about 80%, preferably at least about 90%, even more preferably at least about 95% and most preferably at least about 98% identical to genes that are differentially expressed in the CD34+/CD38−/Lin− cell HSC-substantially enriched populations or cDNAs thereof, and complements thereof, are also within the scope of the invention.

Nucleic acid probes may be obtained by, e.g., polymerase chain reaction (PCR) amplification of gene segments from genomic DNA, cDNA (e.g., by RT-PCR), or cloned sequences. PCR primers are chosen, based on the known sequence of the genes or cDNA, that result in amplification of unique fragments. Computer programs may be used in the design of primers with the required specificity and optimal amplification properties. See, e.g., Oligo version 5.0 (National Biosciences). Factors which apply to the design and selection of primers for amplification are described, for example, by Rylchik, W. (1993) "Selection of Primers for Polymerase Chain Reaction," in Methods in Molecular Biology, Vol. 15, White B. ed., Humana Press, Totowa, N.J. Sequences may be obtained from GenBank or other public sources.

Oligonucleotides of the invention may be synthesized by standard methods known in the art, e.g. by use of an automated DNA synthesizer (such as are commercially available from Biosearch, Applied Biosystems, etc.). As examples, phosphorothioate oligonucleotides may be synthesized by the method of Stein et al., (1988) *Nucl. Acids Res.* 16: 3209), methylphosphonate oligonucleotides may be prepared by use of controlled pore glass polymer supports (Sarin et al., (1988) *Proc. Nat. Acad. Sci. U.S.A.* 85:7448-7451), etc. In another embodiment, the oligonucleotide is a 2'-0-methylribonucleotide (Inoue et al., (1987) *Nucl. Acids Res.* 15: 6131-6148), or a chimeric RNA-DNA analog (Inoue et al., (1987) *FEBS Lett.* 215: 327-330).

Probes having sequences of genes listed in Tables 1 and 2 may also be generated synthetically. Single-step assembly of a gene from large numbers of oligodeoxyribonucleotides may be done as described by Stemmer et al., (1995) *Gene (Amsterdam)* 164(1):49-53. In this method, assembly PCR (the synthesis of long DNA sequences from large numbers of oligodeoxyribonucleotides (oligos)) is described. The method is derived from DNA shuffling (Stemmer (1994) *Nature* 370: 389-391), and does not rely on DNA ligase, but instead relies on DNA polymerase to build increasingly longer DNA fragments during the assembly process. For example, a 1.1-kb fragment containing the TEM-1 beta-lactamase-encoding gene (bla) may be assembled in a single reaction from a total of 56 oligos, each 40 nucleotides (nt) in length. The synthetic gene may be PCR amplified and makes this approach a general method for the rapid and cost-effective synthesis of any gene.

"Rapid amplification of cDNA ends," or RACE, is a PCR method that may be used for amplifying cDNAs from a number of different RNAs. The cDNAs may be ligated to an oligonucleotide linker and amplified by PCR using two primers. One primer may be based on sequence from the instant nucleic acids, for which full length sequence is desired, and a second primer may comprise a sequence that hybridizes to the oligonucleotide linker to amplify the cDNA. A description of this method is reported in PCT Pub. No. WO 97/19110.

In another embodiment, the invention provides a composition comprising a plurality of agents which may detect a polypeptide encoded by a gene differentially expressed in the CD34$^+$/CD38$^-$/Lin$^-$ hematopoietic stem cells. An agent may be, e.g., an antibody. Antibodies to polypeptides described herein may be obtained commercially, or they may be produced according to methods known in the art.

The probes may be attached to a solid support, such as paper, membranes, filters, chips, pins or glass slides, or any other appropriate substrate, such as those further described herein. For example, probes of genes that are differentially expressed in the CD34$^+$/CD38$^-$/Lin$^-$ cell HSC-substantially enriched populations may be attached covalently or non covalently to membranes for use, e.g., in dotblots, or to solids such as to create arrays, e.g., microarrays.

In one embodiment of the present invention, the composition is a microarray. There may be one or more than one probe corresponding to each gene on a microarray. For example, a microarray may contain from 2 to 20 probes corresponding to one gene and preferably about 5 to 10. The probes may correspond to the full length RNA sequence or complement thereof of genes that are differentially expressed in the CD34$^+$/CD38$^-$/Lin$^-$ HSC- substantially enriched population or they may correspond to a portion thereof, which portion is of sufficient length for permitting specific hybridization. Such probes may comprise from about 50 nucleotides to about 100, 200, 500, or 1000 nucleotides or more than 1000 nucleotides. As further described herein, microarrays may also contain oligonucleotide probes, consisting of about 10 to 50 nucleotides, preferably about 15 to 30 nucleotides and even more preferably 20-25 nucleotides. The probes are preferably single stranded. The probe will have sufficient complementarity to its target to provide for the desired level of sequence specific hybridization.

Suitable arrays for use in the present invention will have a site density of greater than 100 different probes per cm$^2$, although any suitable site density is included in the present invention Preferably, the arrays will have a site density of greater than 500/cm$^2$, more preferably greater than about 1000/cm$^2$, and most preferably, greater than about 10,000/cm$^2$. Preferably, the arrays will have more than 100 different probes on a single substrate, more preferably greater than about 1000 different probes still more preferably, greater than about 10,000 different probes and most preferably, greater than 100,000 different probes on a single substrate.

Microarrays maybe prepared by methods known in the art, as described below, or they may be custom made by companies, e.g., Affymetrix (Santa Clara, Calif.).

Generally, two types of microarrays maybe used. These two types are referred to as "synthesis" and "delivery." In the synthesis type, a microarray is prepared in a step-wise fashion by the in situ synthesis of nucleic acids from nucleotides. With each round of synthesis, nucleotides are added to growing chains until the desired length is achieved. In the delivery type of microarray, pre-prepared nucleic acids are deposited onto known locations using a variety of delivery technologies. Numerous articles describe the different microarray technologies, e.g., Shena et al., (1998) *Tibtech* 16: 301; Duggan et al., (1999) *Nat. Genet.*, 21:10; Bowtell et al., (1999) *Nat. Genet.*, 21: 25.

One novel synthesis technology is that developed by Affymetrix (Santa Clara, Calif.), which combines photolithography technology with DNA synthetic chemistry to enable high density oligonucleotide microarray manufacture. Such chips contain up to 400,000 groups of oligonucleotides in an area of about 1.6 cm$^2$. Oligonucleotides are anchored at the 3' end thereby maximizing the availability of single-stranded nucleic acid for hybridization. Generally such chips, referred to as "GeneChips®," contain several oligonucleotides of a particular gene, e.g., between 2-20, such as 5 oligonucleotides. Since Affymetrix (Santa Clara, Calif.) sells custom made microarrays, microarrays containing differentially expressed genes in in vivo engrafting lympho-hematopoietic stem cells may be ordered for purchase from Affymetrix (Santa Clara, Calif.).

Microarrays may also be prepared by mechanical microspotting, e.g., those commercialized at Synteni (Fremont, CA). According to these methods, small quantities of nucleic acids are printed onto solid surfaces. Microspotted arrays prepared at Synteni contain as many as 10,000 groups of cDNA in an area of about 3.6 cm$^2$.

A third group of microarray technologies consist in the "drop-on-demand" delivery approaches, the most advanced of which are the ink-jetting technologies, which utilize piezoelectric and other forms of propulsion to transfer nucleic acids from miniature nozzles to solid surfaces. Inkjet technologies is developed at several centers including Incyte Pharmaceuticals (Palo Alto, Calif.) and Protogene (Palo Alto, Calif.). This technology results in a density of 10,000 spots per cm$^2$. See also, Hughes et al., (2001) *Nat. Biotech.*, 19:342.

Arrays preferably include control and reference nucleic acids. Control nucleic acids are nucleic acids which serve to indicate that the hybridization was effective. For example, all Affymetrix (Santa Clara, Calif.) expression arrays contain sets of probes for several prokaryotic genes, e.g., bioB, bioC and bioD from biotin synthesis of *E. coli* and cre from P1 bacteriophage. Hybridization to these arrays is conducted in the presence of a mixture of these genes or portions thereof, such as the mix provided by Affymetrix (Santa Clara, Calif.) to that effect (Part Number 900299), to thereby confirm that the hybridization was effective. Control nucleic acids included with the target nucleic acids may also be mRNA synthesized from cDNA clones by in vitro transcription. Other control genes that may be included in arrays are polyA controls, such as dap, lys, phe, thr, and trp (which are included on Affymetrix GeneChips®).

Reference nucleic acids allow the normalization of results from one experiment to another, and to compare multiple experiments on a quantitative level. Exemplary reference nucleic acids include housekeeping genes of known expression levels, e.g., GAPDH, hexokinase and actin.

Mismatch controls may also be provided for the probes to the target genes, for expression level controls or for normalization controls. Mismatch controls are oligonucleotide probes or other nucleic acid probes identical to their corresponding test or control probes except for the presence of one or more mismatched bases.

Arrays may also contain probes that hybridize to more than one allele of a gene. For example the array may contain one probe that recognizes allele 1 and another probe that recognizes allele 2 of a particular gene.

Microarrays may be prepared as follows. In one embodiment, an array of oligonucleotides is synthesized on a solid support. Exemplary solid supports include glass, plastics, polymers, metals, metalloids, ceramics, organics, etc. Using chip masking technologies and photoprotective chemistry it is possible to generate ordered arrays of nucleic acid probes. These arrays, which are known, e.g., as "DNA chips," or as very large scale immobilized polymer arrays ("VLSIPS™" arrays) may include millions of defined probe regions on a substrate having an area of about 1 cm² to several cm², thereby incorporating sets of from a few to millions of probes (see U.S. Pat. No. 5,631,734).

The construction of solid phase nucleic acid arrays to detect target nucleic acids is well described in the literature. See Fodor et al., (1991) *Science* 251: 767-777; Sheldon et al., (1993) *Clinical Chemistry* 39(4): 718-719; Kozal et al., (1996) *Nature Medicine* 2(7): 753-759 and Hubbell U.S. Pat. No. 5,571,639; Pinkel et al., PCT/US95/16155 (WO 96/17958); U.S. Pat. Nos. 5,677,195; 5,624,711; 5,599,695; 5,451,683; 5,424,186; 5,412,087; 5,384,261; 5,252,743 and 5,143,854; PCT Patent Publication Nos. 92/10092 and 93/09668; and PCT WO 97/10365. In brief, a combinatorial strategy allows for the synthesis of arrays containing a large number of probes using a minimal number of synthetic steps. For instance, it is possible to synthesize and attach all possible DNA 8 mer oligonucleotides (48, or 65,536 possible combinations) using only 32 chemical synthetic steps. In general, VLSIPS™ procedures provide a method of producing 4 n different oligonucleotide probes on an array using only 4 n synthetic steps (see, e.g., U.S. Pat. No. 5,631,734; 5,143,854 and PCT Patent Publication Nos. WO 90/15070; WO 95/11995 and WO 92/10092).

Light-directed combinatorial synthesis of oligonucleotide arrays on a glass surface maybe performed with automated phosphoramidite chemistry and chip masking techniques similar to photoresis technologies in the computer chip industry. Typically, a glass surface is derivatized with a silane reagent containing a functional group, e.g., a hydroxyl or amine group blocked by a photolabile protecting group. Photolysis through a photolithogaphic mask is used selectively to expose functional groups which are then ready to react with incoming 5'-photoprotected nucleoside phosphoramidites. The phosphoramidites react only with those sites which are illuminated (and thus exposed by removal of the photolabile blocking group). Thus, the phosphoramidites only add to those areas selectively exposed from the preceding step. These steps are repeated until the desired array of sequences have been synthesized on the solid surface.

Algorithms for design of masks to reduce the number of synthesis cycles are described by Hubbel et al., U.S. Pat. Nos. 5,571,639 and 5,593,839. A computer system may be used to select nucleic acid probes on the substrate and design the layout of the array as described in U.S. Pat. No. 5,571,639.

Another method for synthesizing high density arrays is described in U.S. Pat. No. 6,083,697. This method utilizes a novel chemical amplification process using a catalyst system which is initiated by radiation to assist in the synthesis of the polymer sequences. Methods of the present invention include the use of photosensitive compounds which act as catalysts to chemically alter the synthesis intermediates in a manner to promote formation of polymer sequences. Such photosensitive compounds include what are generally referred to as radiation-activated catalysts (RACs), and more specifically photo activated catalysts (PACs). The RACs may by themselves chemically alter the synthesis intermediate or they may activate an autocatalytic compound which chemically alters the synthesis intermediate in a manner to allow the synthesis intermediate to chemically combine with a later added synthesis intermediate or other compound.

Arrays may also be synthesized in a combinatorial fashion by delivering monomers to cells of a support by mechanically constrained flowpaths. See Winkler et al., EP 624,059. Arrays may also be synthesized by spotting monomers reagents on to a support using an ink jet printer. See id. and Pease et al., EP 728,520.

cDNA probes may be prepared according to methods known in the art and further described herein, e.g., reverse-transcription PCR (RT-PCR) of RNA using sequence specific primers. Oligonucleotide probes may be synthesized chemically. Sequences of the genes or cDNA from which probes are made may be obtained, e.g., from GenBank, other public databases or publications.

Nucleic acid probes may be natural nucleic acids, chemically modified nucleic acids, e.g., composed of nucleotide analogs, as long as they have activated hydroxyl groups compatible with the linking chemistry. The protective groups can, themselves, be photolabile. Alternatively, the protective groups may be labile under certain chemical conditions, e.g., acid. In this example, the surface of the solid support may contain a composition that generates acids upon exposure to light. Thus, exposure of a region of the substrate to light generates acids in that region that remove the protective groups in the exposed region. Also, the synthesis method may use 3'- protected 5'-0-phosphoramidite-activated deoxynucleoside. In this case, the oligonucleotide is synthesized in the 5' to 3' direction, which results in a free 5' end.

In one embodiment, oligonucleotides of an array are synthesized using a 96 well automated multiplex oligonucleotide synthesizer (A.M.O.S.) that is capable of making thousands of oligonucleotides (Lashkari et al., (1995) *Proc. Natl. Acad. Sci.*, 93: 7912).

It will be appreciated that oligonucleotide design is influenced by the intended application. For example, it may be desirable to have similar melting temperatures for all of the probes. Accordingly, the length of the probes are adjusted so that the melting temperatures for all of the probes on the array are closely similar (it will be appreciated that different lengths for different probes may be needed to achieve a particular T[m] where different probes have different GC contents). Although melting temperature is a primary consideration in probe design, other factors are optionally used to further adjust probe construction, such as selecting against primer self-complementarity and the like.

Arrays, e.g., microarrrays, may conveniently be stored following fabrication or purchase for use at a later time. Under appropriate conditions, the subject arrays are capable of being stored for at least about 6 months and may be stored for up to one year or longer. Arrays are generally stored at temperatures between about −20° C. to room temperature, where the arrays are preferably sealed in a plastic container, e.g. bag, and shielded from light.

6. Methods of Using Compositions Comprising Probes Derived from Differentially Expressed Genes of the Invention 6.1. Microarrays Generally, determining expression profiles with microarrays involves the following steps: (a) obtaining a mRNA sample from a sample of cells and preparing labeled nucleic acids therefrom (the "target nucleic acids" or "targets"); (b) contact of the target nucleic acids with the array under conditions sufficient for target nucleic acids to bind with corresponding probe on the array, e.g. by hybridization or specific binding; (c) optional removal of unbound targets from the array; and (d) detection of bound targets, and analysis of the results, e.g., using computer based analysis methods. As used herein, "nucleic acid probes" or "probes" are nucleic acids attached to the array, whereas "target nucleic acids" are nucleic acids that are hybridized to the array. Each of these steps is described in more detail below.

(i) Obtaining a mRNA Sample

Nucleic acid specimens may be obtained from an individual to be tested using either "invasive" or "non-invasive" sampling means. A sampling means is said to be "invasive" if it involves the collection of nucleic acids from within the skin or organs of an animal (including, especially, a murine, a human, an ovine, an equine, a bovine, a porcine, a canine, or a feline animal). Examples of invasive methods include blood collection, semen collection, needle biopsy, pleural aspiration, umbilical cord biopsy, etc. Examples of such methods are discussed by Kim et al., (1992) *J. Virol.* 66:3879-3882; Biswas et al., (1990) *Annals NY Acad. Sci.* 590:582-583; Biswas et al., (1991) *J. Clin. Microbiol.* 29:2228-2233.

In one embodiment, one or more cells from a subject or an enriched population of HSC cells to be tested are obtained, and RNA is isolated from the cells. When obtaining the cells, it is preferable to obtain a sample as enriched as practicable in cells of the desired type, e.g., a sample of cells enriched by 2-fold, 5-fold, 10-fold, 50-fold, 100-fold, 500-fold, 1000-fold or more in cells of the desired type. Higher levels of enrichment are preferable, since such a sample is more likely to provide clear gene expression data, i.e., gene expression data reflecting the profile of the desired cell type. For example, it is possible to obtain a cell sample from a subject, and then to enrich it in the desired in vivo engrafting hematopoietic stem cell type using positive and/or negative selection as described previously.

In one embodiment, RNA is obtained from a single cell. It is also possible to obtain cells from a subject, substantially enriched for the desired cell type, i.e. in vivo engrafting hematopoietic stem cells and culture the cells in vitro, such as to obtain a larger population of cells from which RNA may be extracted. Methods for establishing cultures of non-transformed cells, i.e., primary cell cultures, are known in the art and are described herein.

When isolating RNA from tissue samples or cells from individuals, it may be important to prevent any further changes in gene expression after the tissue or cells has been removed from the subject. Expression levels are known to change rapidly following perturbations, e.g., heat shock or activation with lipopolysaccharide (LPS) or other reagents. In addition, the RNA in the tissue and cells may quickly become degraded. Accordingly, in a preferred embodiment, the cells obtained from a subject are snap frozen as soon as possible.

RNA may be extracted from the tissue sample by a variety of methods, e.g., the guanidium thiocyanate lysis followed by CsCl centrifugation (Chirgwin et al., (1979) *Biochemistry*. 18:5294-5299). RNA from single cells may be obtained as described in methods for preparing cDNA libraries from single cells, such as those described in Dulac (1998) *Curr. Top. Dev. Biol.* 36, 245 and Jena et al., (1996) *J. Immunol. Methods.* 190:199. Care to avoid RNA degradation must be taken, e.g., by inclusion of a ribonuclease inhibitor such as RNAsin.

The RNA sample may then be enriched in particular species. In one embodiment, poly(A)+RNA is isolated from the RNA sample. In general, such purification takes advantage of the poly-A tails on mRNA. In particular and as noted above, poly-T oligonucleotides may be immobilized within on a solid support to serve as affinity ligands for mRNA. Kits for this purpose are commercially available, e.g., the Message-Maker kit (Life Technologies, Grand Island, N.Y.).

In a preferred embodiment, the RNA population is enriched in sequences of interest, such as those of the genes differentially expressed in hematopoietic stem cells. Enrichment may be undertaken, e.g., by primer-specific cDNA synthesis, or multiple rounds of linear amplification based on cDNA synthesis and template-directed in vitro transcription (see, e.g., Wang et al., (1989) *Proc. Natl. Acad. Sci.*, 86, 9717; Dulac et al., supra, and Jena et al., supra).

The population of RNA, enriched or not in particular species or sequences, may further be amplified. Such amplification is particularly important when using RNA from a single or a few cells. A variety of amplification methods are suitable for use in the methods of the invention, including, e.g., PCR; ligase chain reaction (LCR)(see, e.g., Wu and Wallace (1989) Genomics 4, 560, Landegren et al., (1988) *Science* 241, 1077); self-sustained sequence replication (SSR)(see, e.g., Guatelli et al., (1990) *Proc. Nat. Acad. Sci. USA,* 87:1874); nucleic acid based sequence amplification (NASBA) and transcription amplification (see, e.g., Kwoh et al., (1989) *Proc. Natl. Acad. Sci. USA* 86, 1173). For PCR technology, see, e.g., PCR Technology: Principles and Applications for DNA Amplification (ed. H. A. Erlich, Freeman Press, N.Y., N.Y., 1992); PCR Protocols: A Guide to Methods and applications (eds. Innis et al., (1990) Academic Press, San Diego, Calif.); Mattila et al. (1991) Nucleic Acids Res. 19:4967; Eckert et al., (1991) PCR Methods and Applications 1:17; PCR (eds. McPherson et al., , IRL Press, Oxford); and U.S. Pat. No. 4,683,202. Methods of amplification are described, e.g., in Ohyama et al., (2000)*BioTechniques* 29:530; Luo et al., (1999) *Nat. Med.* 5, 117; Hegde et al., (2000) *BioTechniques* 29:548; Kacharmina et al., (1999) *Meth. Enzymol.* 303:3; Livesey et al., (2000) *Curr. Biol.* 10:301; Spirin et al., (1999) *Invest. Ophtalmol. Vis. Sci.* 40:3108; and Sakai et al., (2000)*Anal. Biochem.* 287:32. RNA amplification and cDNA synthesis may also be conducted in cells in situ (see, e.g., Eberwine et al., (1992) *Proc. Nat. Acad. Sci.*, 89:3010).

One of skill in the art will appreciate that whatever amplification method is used, if a quantitative result is desired, care must be taken to use a method that maintains or controls for the relative frequencies of the amplified nucleic acids to achieve quantitative amplification. Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. A high density array may then include probes specific to the internal standard for quantification of the amplified nucleic acid.

One preferred internal standard is a synthetic AW106 cRNA. The AW106 cRNA is combined with RNA isolated from the sample according to standard techniques known to those of skill in the art. The RNA is then reverse transcribed using a reverse transcriptase to provide copy DNA. The cDNA sequences are then amplified (e.g., by PCR) using labeled primers. The amplification products are separated, typically by electrophoresis, and the amount of radioactivity (proportional to the amount of amplified product) is determined. The amount of mRNA in the sample is then calculated by comparison with the signal produced by the known AW106 RNA standard. Detailed protocols for quantitative PCR are provided in PCR Protocols, A Guide to Methods and Applications, Innis et al., Academic Press, Inc. N.Y., (1990).

In a preferred embodiment, a sample mRNA is reverse transcribed with a reverse transcriptase and a primer consisting of oligo(dT) and a sequence encoding the phage T7 promoter to provide single stranded DNA template. The second DNA strand is polymerized using a DNA polymerase. After synthesis of double-stranded cDNA, T7 RNA polymerase is added and RNA is transcribed from the cDNA template. Successive rounds of transcription from each single cDNA template results in amplified RNA. Methods of in vitro polymerization are well known to those of skill in the art (see, e.g., Sambrook, (supra) and this particular method is described in detail by Van Gelder et al., (1990) *Proc. Natl. Acad. Sci. USA.* 87: 1663-1667 who demonstrate that in vitro amplification according to this method preserves the relative frequencies of the various RNA transcripts. Moreover, Eberwine et al., (1992) *Proc. Natl. Acad. Sci. USA.* 89: 3010-3014 provide a protocol that uses two rounds of amplification via in vitro transcription to achieve greater than $10^6$ fold amplification of the original starting material, thereby permitting expression monitoring even where biological samples are limited.

It will be appreciated by one of skill in the art that the direct transcription method described above provides an antisense (aRNA) pool. Where antisense RNA is used as the target nucleic acid, the oligonucleotide probes provided in the array are chosen to be complementary to subsequences of the antisense nucleic acids. Conversely, where the target nucleic acid pool is a pool of sense nucleic acids, the oligonucleotide probes are selected to be complementary to subsequences of the sense nucleic acids. Finally, where the nucleic acid pool is double stranded, the probes may be of either sense as the target nucleic acids include both sense and antisense strands.

(ii) Labeling of the nucleic acids to be analyzed

Generally, the target molecules will be labeled to permit detection of hybridization of target molecules to a microarray. By labeled is meant that the probe comprises a member of a signal producing system and is thus detectable, either directly or through combined action with one or more additional members of a signal producing system. Examples of directly detectable labels include isotopic and fluorescent moieties incorporated into, usually covalently bonded to, a moiety of the probe, such as a nucleotide monomeric unit, e.g. dNMP of the primer, or a photoactive or chemically active derivative of a detectable label which may be bound to a functional moiety of the probe molecule.

Nucleic acids may be labeled after or during enrichment and/or amplification of RNAs. For example, labeled cDNA is prepared from mRNA by oligo dT-primed or random-primed reverse transcription, both of which are well known in the art (see, e.g., Klug and Berger. (1987) *Methods Enzymol.* 152: 316-325). Reverse transcription may be carried out in the presence of a dNTP conjugated to a detectable label, most preferably a fluorescently labeled dNTP. Alternatively, isolated mRNA may be converted to labeled antisense RNA synthesized by in vitro transcription of double-stranded cDNA in the presence of labeled dNTPs (Lockhart et al., (1996) *Nature Biotech.* 14:1675 which is incorporated by reference in its entirety for all purposes). In alternative embodiments, the cDNA or RNA probe may be synthesized in the absence of detectable label and may be labeled subsequently, e.g., by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent.

In one embodiment, labeled cDNA is synthesized by incubating a mixture containing 0.5 mM dGTP, dATP and dCTP plus 0.1 mM dTTP plus fluorescent deoxyribonucleotides (e.g., 0.1 mM Rhodamine 110 UTP (Perkin Elmer Cetus) or 0.1 mM Cy3 dUTP (Amersham)) with reverse transcriptase (e.g., SuperScript.™.II, LTI Inc.) at 42° C. for 60 min.

Fluorescent moieties or labels of interest include coumarin and its derivatives, e.g. 7-amino-4-methylcoumarin, aminocoumarin, bodipy dyes, such as Bodipy FL, cascade blue, fluorescein and its derivatives, e.g. fluorescein isothiocyanate, Oregon green, rhodamine dyes, e.g. Texas red, tetramethylrhodamine, eosins and erythrosins, cyanine dyes, e.g. Cy2, Cy3, Cy3.5, CyS, Cy5.5, Cy7, FluorX, macrocyclic chelates of lanthanide ions, e.g. quantum dye™, fluorescent energy transfer dyes, such as thiazole orange-ethidium heterodimer, TOTAB, dansyl, etc. Individual fluorescent compounds which have functionalities for linking to an element desirably detected in an apparatus or assay of the invention, or which may be modified to incorporate such functionalities include, e.g., dansyl chloride; fluoresceins such as 3,6-dihydroxy-9-phenylxanthydrol; rhodamineisothiocyanate; N-phenyl 1-amino-8-sulfonatonaphthalene; N-phenyl 2-amino-6-sulfonatonaphthalene; 4-acetamido4-isothiocyanato-stilbene-2, 2'-disulfonic acid; pyrene-3-sulfonic acid; 2-toluidinonaphthalene-6-sulfonate; N-phenyl-N-methyl-2-aminoaphthalene-6-sulfonate; ethidium bromide; stebrine; auromine-0,2-(9'-anthroyl)palmitate; dansyl phosphatidylethanolamine; N,N'-dioctadecyl oxacarbocyanine: N,N'-dihexyl oxacarbocyanine; merocyanine, 4-(3'-pyrenyl)stearate; d-3-aminodesoxy-equilenin; 12-(9'-anthroyl)stearate; 2-methylanthracene; 9-vinylanthracene; 2,2'(vinylene-p-phenylene)bisbenzoxazole; p-bis(2-methyl-5-phenyl-oxazolyl)) benzene; 6-dimethylamino-1,2-benzophenazin; retinol; bis (3'-aminopyridinium) 1,10-decandiyl diiodide; sulfonaphthylhydrazone of hellibrienin; chlorotetracycline; N-(7-dimethylamino-4-methyl-2-oxo-3-chromenyl)maleimide; N-(p-(2benzimidazolyl)-phenyl)maleimide; N-(4-fluoranthyl)maleimide; bis(homovanillic acid); resazarin; 4-chloro-7-nitro-2,1,3-benzooxadiazole; merocyanine 540; resorufin; rose bengal; and 2,4-diphenyl-3(2H)-furanone. (see, e.g., Kricka, 1992, Nonisotopic DNA Probe Techniques, Academic Press San Diego, Calif.). Many fluorescent tags are commercially available from SIGMA chemical company (Saint Louis, Mo.), Amersham, Molecular Probes, R&D systems (Minneapolis, Minn.), Pharmacia LKB Biotechnology (Piscataway, N.J.), CLONTECH Laboratories, Inc. (Palo Alto, Calif.), Chem Genes Corp., Aldrich Chemical Company (Milwaukee, Wis.), Glen Research, Inc., GIBCO BRL Life Technologies, Inc. (Gaithersberg, Md.), Fluka Chemica-Biochemika Analytika (Fluka Chemie AG, Buchs, Switzerland), and Applied Biosystems (Foster City, Calif.) as well as other commercial sources known to one of skill.

Chemiluminescent labels include luciferin and 2,3-dihydrophthalazinediones, e.g., luminol.

Isotopic moieties or labels of interest include $^{32}P$, $^{33}P$, $^{35}S$, $^{125}I$, $^{2}H$, $^{14}C$, and the like (see Zhao et al., (1995) *Gene* 156:207; Pietu et al., (1996) *Genome Res.* 6:492). However, because of scattering of radioactive particles, and the consequent requirement for widely spaced binding sites, use of radioisotopes is a less-preferred embodiment.

Labels may also be members of a signal producing system that act in concert with one or more additional members of the same system to provide a detectable signal. Illustrative of such labels are members of a specific binding pair, such as ligands, e.g. biotin, fluorescein, digoxigenin, antigen, polyvalent cations, chelator groups and the like, where the members specifically bind to additional members of the signal producing system, where the additional members provide a detectable signal either directly or indirectly, e.g. antibody conjugated to a fluorescent moiety or an enzymatic moiety capable of converting a substrate to a chromogenic product, e.g. alkaline phosphatase conjugate antibody and the like.

Additional labels of interest include those that provide for signal only when the probe with which they are associated is specifically bound to a target molecule, where such labels include: "molecular beacons" as described in Tyagi & Kramer. (1996) *Nature Biotechnology* 14:303 and EP 0 070 685 B1. Other labels of interest include those described in U.S. Pat. No. 5,563,037; WO 97/17471 and WO 97/17076.

In some cases, hybridized target nucleic acids may be labeled following hybridization. For example, where biotin labeled dNTPs are used in, e.g., amplification or transcription, streptavidin linked reporter groups may be used to label hybridized complexes.

In other embodiments, the target nucleic acid is not labeled. In this case, hybridization may be determined, e.g., by plasmon resonance, as described, e.g., in Thiel et al., (1997) *Anal. Chem.* 69:4948.

In one embodiment, a plurality (e.g., 2, 3, 4, 5 or more) of sets of target nucleic acids are labeled and used in one hybridization reaction ("multiplex" analysis). For example, one set of nucleic acids may correspond to RNA from one cell and another set of nucleic acids may correspond to RNA from another cell. The plurality of sets of nucleic acids may be labeled with different labels, e.g., different fluorescent labels which have distinct emission spectra so that they may be distinguished. The sets may then be mixed and hybridized simultaneously to one microarray.

For example, the two different cells may used. In one instance, the cells could be: (a) a blood cell obtained from a patient suffering from leukemia or lymphoma and (b) a blood cell obtained from a healthy individual. Alternatively, the cells may be: (a) a diseased blood cell of a patient diagnosed as having leukemia or lymphoma and (b) a blood cell of a patient suspected of having leukemia or lymphoma. In another embodiment, one biological sample is exposed to a drug and another biological sample of the same type is not exposed to the drug. The cDNA derived from each of the two cell types are differently labeled so that they may be distinguished. In one embodiment, for example, cDNA from a diseased cell is synthesized using a fluorescein-labeled dNTP, and cDNA from a second cell, i.e., the normal cell, is synthesized using a rhodamine-labeled dNTP. When the two cDNAs are mixed and hybridized to the microarray, the relative intensity of signal from each cDNA set is determined for each site on the array, and any relative difference in abundance of a particular mRNA detected.

In the example described above, the cDNA from the diseased cell will fluoresce green when the fluorophore is stimulated and the cDNA from the cell of a normal subject will fluoresce red. As a result, if the two cells express the same level of a given gene, that particular mRNA will be equally prevalent in both cells and, upon reverse transcription, red-labeled and green-labeled cDNA will be equally prevalent. When hybridized to the microarray, the binding site(s) for that species of RNA will emit wavelengths characteristic of both fluorophores (and appear brown in combination). In contrast, if the two cells differ in their expression of the given gene, the ratio of green to red fluorescence will be different.

The use of a two-color fluorescence labeling and detection scheme to define alterations in gene expression has been described, e.g., in Shena et al., (1995) *Science.* 270:467-470. An advantage of using cDNA labeled with two different fluorophores is that a direct and internally controlled comparison of the mRNA levels corresponding to each arrayed gene in two cell states may be made, and variations due to minor differences in experimental conditions (e.g, hybridization conditions) will not affect subsequent analyses.

Examples of distinguishable labels for use when hybridizing a plurality of target nucleic acids to one array are well known in the art and include: two or more different emission wavelength fluorescent dyes, like Cy3 and Cy5, combination of fluorescent proteins and dyes, like phicoerythrin and Cy5, two or more isotopes with different energy of emission, like $^{32}p$ and $^{33}p$, gold or silver particles with different scattering spectra, labels which generate signals under different treatment conditions, like temperature, pH, treatment by additional chemical agents, etc., or generate signals at different time points after treatment. Using one or more enzymes for signal generation allows for the use of an even greater variety of distinguishable labels, based on different substrate specificity of enzymes (alkaline phosphatase/peroxidase).

Further, it is preferable in order to reduce experimental error to reverse the fluorescent labels in two-color differential hybridization experiments to reduce biases peculiar to individual genes or array spot locations. In other words, it is preferable to first measure gene expression with one labeling (e.g., labeling nucleic acid from a first cell with a first fluorochrome and nucleic acid from a second cell with a second fluorochrome) of the mRNA from the two cells being measured, and then to measure gene expression from the two cells with reversed labeling (e.g., labeling nucleic acid from the first cell with the second fluorochrome and nucleic acid from the second cell with the first fluorochrome). Multiple measurements over exposure levels and perturbation control parameter levels provide additional experimental error control.

The quality of labeled nucleic acids may be evaluated prior to hybridization to an array. For example, a sample of the labeled nucleic acids may be hybridized to probes derived from the 5', middle and 3' portions of genes known to be or suspected to be present in the nucleic acid sample. This will be indicative as to whether the labeled nucleic acids are full length nucleic acids or whether they are degraded. In one embodiment, the GeneChipe® Test3 Array from Affymetrix (Santa Clara, Calif.) may be used for that purpose. This array contains probes representing a subset of characterized genes from several organisms including mammals. Thus, the quality of a labeled nucleic acid sample may be determined by hybridization of a fraction of the sample to an array, such as the GeneChip® Test3 Array from Affymetrix (Santa Clara, Calif.).

(iii) Hybridization of the Target Nucleic Acids to the Microarray

The next step is to contact the labeled target nucleic acids with the array under conditions sufficient for binding between the probe and the target of the array. In a preferred embodiment, the probe will be contacted with the array under conditions sufficient for hybridization to occur between the labeled nucleic acids and probes on the microarray, where the hybridization conditions will be selected in order to provide for the desired level of hybridization specificity.

Contact of the array and probe involves contacting the array with an aqueous medium comprising the probe. Contact may be achieved in a variety of different ways depending on specific configuration of the array. For example, where the array simply comprises the pattern of size separated targets on the surface of a "plate-like" rigid substrate, contact may be accomplished by simply placing the array in a container comprising the probe solution, such as a polyethylene bag, and the like. In other embodiments where the array is entrapped in a separation media bounded by two rigid plates, the opportunity exists to deliver the probe via electrophoretic means. Alternatively, where the array is incorporated into a biochip device having fluid entry and exit ports, the probe solution may be introduced into the chamber in which the pattern of target molecules is presented through the entry port, where fluid introduction could be performed manually or with an automated device. In multiwell embodiments, the probe solution will be introduced in the reaction chamber comprising the array, either manually, e.g. with a pipette, or with an automated fluid handling device.

Contact of the probe solution and the targets will be maintained for a sufficient period of time for binding between the probe and the target to occur. Although dependent on the nature of the probe and target, contact will generally be maintained for a period of time ranging from about 10 min to 24 hrs, usually from about 30 min to 12 hrs and more usually from about 1 hr to 6 hrs.

When using commercially available microarrays, adequate hybridization conditions are provided by the manufacturer. When using non-commercial microarrays, adequate hybridization conditions may be determined based on the following hybridization guidelines, as well as on the hybridization conditions described in the numerous published articles on the use of microarrays.

Nucleic acid hybridization and wash conditions are optimally chosen so that the probe "specifically binds" or "specifically hybridizes" to a specific array site, i.e., the probe hybridizes, duplexes or binds to a sequence array site with a complementary nucleic acid sequence but does not hybridize to a site with a non-complementary nucleic acid sequence. As used herein, one polynucleotide sequence is considered complementary to another when, if the shorter of the polynucleotides is less than or equal to 25 bases, there are no mismatches using standard base-pairing rules or, if the shorter of the polynucleotides is longer than 25 bases, there is no more than a 5% mismatch. Preferably, the polynucleotides are perfectly complementary (no mismatches). It may easily be demonstrated that specific hybridization conditions result in specific hybridization by carrying out a hybridization assay including negative controls.

Hybridization is carried out in conditions permitting essentially specific hybridization. The length of the probe and GC content will determine the Tm of the hybrid, and thus the hybridization conditions necessary for obtaining specific hybridization of the probe to the template nucleic acid. These factors are well known to a person of skill in the art, and may also be tested in assays. An extensive guide to the hybridization of nucleic acids is found in Tijssen (1993), "Laboratory Techniques in biochemistry and molecular biology-hybridization with nucleic acid probes." Generally, stringent conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Highly stringent conditions are selected to be equal to the Tm point for a particular probe. Sometimes the term "Td" is used to define the temperature at which at least half of the probe dissociates from a perfectly matched target nucleic acid. In any case, a variety of estimation techniques for estimating the Tm or Td are available, and generally described in Tijssen, supra. Typically, G-C base pairs in a duplex are estimated to contribute about 3° C. to the Tm, while A-T base pairs are estimated to contribute about 2° C., up to a theoretical maximum of about 80-100° C. However, more sophisticated models of Tm and Td are available and appropriate in which G-C stacking interactions, solvent effects, the desired assay temperature and the like are taken into account. For example, probes may be designed to have a dissociation temperature (Td) of approximately 60° C., using the formula: $Td=(((((3\times \#GC)+(2\times \#AT))\times 37)-562)/\#bp)-5$; where #GC, #A and #bp are the number of guanine-cytosine base pairs, the number of adenine-thymine base pairs, and the number of total base pairs, respectively, involved in the annealing of the probe to the template DNA.

The stability difference between a perfectly matched duplex and a mismatched duplex, particularly if the mismatch is only a single base, may be quite small, corresponding to a difference in Tm between the two of as little as 0.5 degrees. See Tibanyenda et al., (1984) *Eur. J. Biochem.*, 139:19 and Ebel et al., (1992) *Biochem.*, 31:12083. More importantly, it is understood that as the length of the homology region increases, the effect of a single base mismatch on overall duplex stability decreases.

Theory and practice of nucleic acid hybridization is described, e.g., in S. Agrawal (ed.) *Methods in Molecular Biology*, volume 20; and Tijssen (1993) *Laboratory Techniques in biochemistry and molecular biology-hybridization with nucleic acid probes*, e.g., part I chapter 2 "Overview of principles of hybridization and the strategy of nucleic acid probe assays", Elsevier, New York provide a basic guide to nucleic acid hybridization.

Certain microarrays are of "active" nature, i.e., they provide independent electronic control over all aspects of the hybridization reaction (or any other affinity reaction) occurring at each specific microlocation. These devices provide a new mechanism for affecting hybridization reactions which is called electronic stringency control (ESC). The active devices of this invention may electronically produce "different stringency conditions" at each microlocation. Thus, all hybridizations may be carried out optimally in the same bulk solution. These arrays are described in U.S. Pat. No. 6,051,380.

In a preferred embodiment, background signal is reduced by the use of a detergent (e.g, C-TAB) or a blocking reagent (e.g., sperm DNA, cot-1 DNA, etc.) during the hybridization to reduce non-specific binding. In a particularly preferred (embodiment, the hybridization is performed in the presence of about 0.5 mg/ml DNA (e.g., herring sperm DNA). The use of blocking agents in hybridization is well known to those of skill in the art (see, e.g., Chapter 8 in Laboratory Techniques in Biochemistry and Molecular Biology, Vol. 24: Hybridization With Nucleic Acid Probes, P. Tijssen, ed. Elsevier, N.Y., (1993)).

The method may or may not further comprise a non-bound label removal step prior to the detection step, depending on the particular label employed on the target nucleic acid. For example, in certain assay formats (e.g., "homogenous assay formats") a detectable signal is only generated upon specific binding of target to probe. As such, in these assay formats, the hybridization pattern may be detected without a non-bound label removal step. In other embodiments, the label employed will generate a signal whether or not the target is specifically bound to its probe. In such embodiments, the non-bound labeled target is removed from the support surface. One means of removing the non-bound labeled target is to perform the well known technique of washing, where a variety of wash solutions and protocols for their use in removing non-bound label are known to those of skill in the art and may be used. Alternatively, non-bound labeled target may be removed by electrophoretic means.

Where all of the target sequences are detected using the same label, different arrays will be employed for each physiological source (where different could include using the same array at different times). The above methods may be varied to provide for multiplex analysis, by employing different and distinguishable labels for the different target populations (representing each of the different physiological sources being assayed). According to this multiplex method, the same array is used at the same time for each of the different target populations.

In another embodiment, hybridization is monitored in real time using a charge-coupled device imaging camera (Guschin et al., (1997) *Anal. Biochem.*, 250:203). Synthesis of arrays on optical fiber bundles allows easy and sensitive reading (Healy et al., (1997) Anal. Biochem. 251:270). In another embodiment, real time hybridization detection is carried out on microarrays without washing using evanescent wave effect that excites only fluorophores that are bound to the surface (see, e.g., Stimpson et al., (1995) Proc. Natl. Acad. Sci., 92:6379).

(iv) Detection of Hybridization and Analysis of Results

The above steps result in the production of hybridization patterns of labeled target nucleic acid on the array surface. The resultant hybridization patterns of labeled nucleic acids may be visualized or detected in a variety of ways, with the particular manner of detection being chosen based on the particular label of the target nucleic acid, where representative detection means include scintillation counting, autoradiography, fluorescence measurement, colorimetric measurement, light emission measurement, light scattering, and the like.

One method of detection includes an array scanner that is commercially available from Affymetrix (Santa Clara, Calif.), e.g., the 417™ Arrayer, the 418™ Array Scanner, or the Agilent GeneArray™ Scanner. This scanner is controlled from the system computer with a Windows® interface and easy-to-use software tools. The output is a 16-bit.tif file that may be directly imported into or directly read by a variety of software applications. Preferred scanning devices are described in, e.g., U.S. Pat. Nos. 5,143,854 and 5,424,186.

When fluorescently labeled probes are used, the fluorescence emissions at each site of a transcript array may be, preferably, detected by scanning confocal laser microscopy. In one embodiment, a separate scan, using the appropriate excitation line, is carried out for each of the two fluorophores used. Alternatively, a laser may be used that allows simultaneous specimen illumination at wavelengths specific to the two fluorophores and emissions from the two fluorophores may be analyzed simultaneously (see Shalon et al., (1996) Genome Research 6:639-645, which is incorporated by reference in its entirety for all purposes). In a preferred embodiment, the arrays are scanned with a laser fluorescent scanner with a computer controlled X-Y stage and a microscope objective. Sequential excitation of the two fluorophores may be achieved with a multi-line, mixed gas laser and the emitted light is split by wavelength and detected with two photomultiplier tubes. Fluorescence laser scanning devices are described in Schena et al., (1996) Genome Res. 6:639-645 and in other references cited herein. Alternatively, the fiber-optic bundle described by Ferguson et al., (1996) Nature Biotech. 14:1681-1684, may be used to monitor mRNA abundance levels.

In one embodiment in which fluorescent target nucleic acids are used, the arrays may be scanned using lasers to excite fluorescently labeled targets that have hybridized to regions of probe arrays, which may then be imaged using charged coupled devices ("CCDs") for a wide field scanning of the array. Alternatively, another particularly useful method for gathering data from the arrays is through the use of laser confocal microscopy which combines the ease and speed of a readily automated process with high resolution detection.

Following the data gathering operation, the data will typically be reported to a data analysis operation. To facilitate the sample analysis operation, the data obtained by the reader from the device will typically be analyzed using a digital computer. Typically, the computer will be appropriately programmed for receipt and storage of the data from the device, as well as for analysis and reporting of the data gathered, e.g., subtraction of the background, deconvolution multi-color images, flagging or removing artifacts, verifying that controls have performed properly, normalizing the signals, interpreting fluorescence data to determine the amount of hybridized target, normalization of background and single base mismatch hybridizations, and the like. In a preferred embodiment, a system comprises a search function that allows one to search for specific patterns, e.g., patterns relating to differential gene expression. A system preferably allows one to search for patterns of gene expression between more than two samples.

A desirable system for analyzing data is a general and flexible system for the visualization, manipulation, and analysis of gene expression data. Such a system preferably includes a graphical user interface for browsing and navigating through the expression data, allowing a user to selectively view and highlight the genes of interest. The system also preferably includes sort and search functions and is preferably available for general users with PC, Mac or Unix workstations. Also preferably included in the system are clustering algorithms that are qualitatively more efficient than existing ones. The accuracy of such algorithms is preferably hierarchically adjustable so that the level of detail of clustering may be systematically refined as desired.

Various algorithms are available for analyzing the gene expression profile data, e.g., the type of comparisons to perform. In certain embodiments, it is desirable to group genes that are co-regulated. This allows the comparison of large numbers of profiles. A preferred embodiment for identifying such groups of genes involves clustering algorithms (for reviews of clustering algorithms, see, e.g., Fukunaga (1990) Statistical Pattern Recognition, 2nd Ed., Academic Press, San Diego; Everitt (1974) Cluster Analysis, London: Heinemann Educ. Books; Hartigan, 1975, Clustering Algorithms, New York: Wiley; Sneath and Sokal (1973) Numerical Taxonomy, Freeman; Anderberg (1973) Cluster Analysis for Applications, Academic Press: New York).

Clustering analysis is useful in helping to reduce complex patterns of thousands of time curves into a smaller set of representative clusters. Some systems allow the clustering and viewing of genes based on sequences. Other systems allow clustering based on other characteristics of the genes, e.g., their level of expression (see, e.g., U.S. Pat. No. 6,203,987). Other systems permit clustering of time curves (see, e.g. U.S. Pat. No. 6,263,287). Cluster analysis may be performed using the hclust routine (see, e.g., "hclust" routine from the software package S-Plus, MathSoft, Inc., Cambridge, Mass.).

In some specific embodiments, genes are grouped according to the degree of co-variation of their transcription, presumably co-regulation, as described in U.S. Pat. No. 6,203,987. Groups of genes that have co-varying transcripts are termed "genesets." Cluster analysis or other statistical classification methods may be used to analyze the co-variation of transcription of genes in response to a variety of perturbations, e.g. caused by a disease or a drug. In one specific embodiment, clustering algorithms are applied to expression profiles to construct a "similarity tree" or "clustering tree" which relates genes by the amount of co-regulation exhibited. Genesets are defined on the branches of a clustering tree by cutting across the clustering tree at different levels in the branching hierarchy.

In some embodiments, a gene expression profile is converted to a projected gene expression profile. The projected gene expression profile is a collection of geneset expression values. The conversion is achieved, in some embodiments, by averaging the level of expression of the genes within each geneset. In some other embodiments, other linear projection processes may be used. The projection operation expresses the profile on a smaller and biologically more meaningful set of coordinates, reducing the effects of measurement errors by averaging them over each cellular constituent sets and aiding biological interpretation of the profile.

6.2. Other Methods for Determining Gene Expression Levels

In certain embodiments, it is sufficient to determine the expression of one or only a few genes, as opposed to hundreds or thousands of genes. Although microarrays may be used in these embodiments, various other methods of detection of gene expression are available. This section describes a few exemplary methods for detecting and quantifying mRNA or polypeptide encoded thereby. Where the first step of the methods includes isolation of mRNA from cells, this step may be conducted as described above. Labeling of one or more nucleic acids may be performed as described above.

In one embodiment, mRNA obtained form a sample is reverse transcribed into a first cDNA strand and subjected to PCR, e.g., RT-PCR. House keeping genes, or other genes whose expression does not vary may be used as internal controls and controls across experiments. Following the PCR reaction, the amplified products may be separated by electrophoresis and detected. By using quantitative PCR, the level of amplified product will correlate with the level of RNA that was present in the sample. The amplified samples may also be separated on a agarose or polyacrylamide gel, transferred onto a filter, and the filter hybridized with a probe specific for the gene of interest. Numerous samples may be analyzed simultaneously by conducting parallel PCR amplification, e.g., by multiplex PCR.

In another embodiment, mRNA levels are determined by dotblot analysis and related methods (see, e.g., G. A. Beltz et al., (1985) in *Methods in Enzymology*, Vol. 100, Part B, R. Wu, L. Grossmam, K. Moldave, Eds., Academic Press, New York, Chapter 19, pp. 266-308). In one embodiment, a specified amount of RNA extracted from cells is blotted (i.e., non-covalently bound) onto a filter, and the filter is hybridized with a probe of the gene of interest. Numerous RNA samples may be analyzed simultaneously, since a blot may comprise multiple spots of RNA. Hybridization is detected using a method that depends on the type of label of the probe. In another dotblot method, one or more probes of one or more differentially expressed genes in hematopoietic stem cells are attached to a membrane, and the membrane is incubated with labeled nucleic acids obtained from and optionally derived from RNA of a cell or tissue of a subject. Such a dotblot is essentially an array comprising fewer probes than a microarray.

"Dot blot" hybridization gained wide-spread use, and many versions were developed (see, e.g., M. L. M. Anderson and B. D. Young (1985) *Nucleic Acid Hybridization—A Practical Approach*, B. D. Hames and S. J. Higgins, Eds., IRL Press, Washington D.C., Chapter 4, pp. 73-111).

Another format, the so-called "sandwich" hybridization, involves covalently attaching oligonucleotide probes to a solid support and using them to capture and detect multiple nucleic acid targets (see, e.g., M. Ranki et al., (1983) *Gene* 21:77-85; UK Patent Application GB 2156074A; U.S. Pat. No. 4,563,419; PCT WO 86/03782; U.S. Pat. No. 4,751,177; PCT WO 90/01564; Wallace et al., (1979) *Nucleic Acid Res.* 6(11): 3543 and Connor et al., (1983) *Proc. Natl. Acad. Sci. USA* 80:278-282). Multiplex versions of these formats are called "reverse dot blots."

mRNA levels may also be determined by Northern blots. Specific amounts of RNA are separated by gel electrophoresis and transferred onto a filter which is then hybridized with a probe corresponding to the gene of interest. This method, although more burdensome when numerous samples and genes are to be analyzed provides the advantage of being very accurate.

A preferred method for high throughput analysis of gene expression is the serial analysis of gene expression (SAGE) technique, first described in Velculescu et al., (1995) *Science.* 270:484-487. Among the advantages of SAGE is that it has the potential to provide detection of all genes expressed in a given cell type, provides quantitative information about the relative expression of such genes, permits ready comparison of gene expression of genes in two cells, and yields sequence information that may be used to identify the detected genes. Thus far, SAGE methodology has proved itself to reliably detect expression of regulated and nonregulated genes in a variety of cell types (Velculescu et al., (1997) *Cell.* 88:243-251; Zhang et al., (1997) *Science.* 276:1268-1272 and Velculescu et al., (1999) *Nat. Genet.* 23:387-388.

Techniques for producing and probing nucleic acids are further described, for example, in Sambrook et al., (1989) "*Molecular Cloning: A Laboratory Manuar*" (New York, Cold Spring Harbor Laboratory).

Alternatively, the level of expression of one or more genes differentially expressed during a purified population of hematopoietic stem cells may be determined by in situ hybridization. In one embodiment, a tissue sample is obtained from a subject, the tissue sample is sliced, and in situ hybridization is performed according to methods known in the art, to determine the level of expression of the genes of interest.

In other methods, the level of expression of a gene is detected by measuring the level of protein encoded by the gene. This may be done, e.g., by immunoprecipitation, ELISA, or immunohistochemistry using an agent, e.g., an antibody, that specifically detects the protein encoded by the gene. Other techniques include Western blot analysis. Immunoassays are commonly used to quantitate the levels of proteins in cell samples, and many other immunoassay techniques are known in the art. The invention is not limited to a particular assay procedure, and therefore is intended to include both homogeneous and heterogeneous procedures. Exemplary immunoassays which may be conducted according to the invention include fluorescence polarization immunoassay (FPIA), fluorescence immunoassay (FIA), enzyme immunoassay (EIA), nephelometric inhibition immunoassay (NIA), enzyme linked immunosorbent assay (ELISA), and radioimmunoassay (RIA). An indicator moiety, or label group, may be attached to the subject antibodies and is selected so as to meet the needs of various uses of the method which are often dictated by the availability of assay equipment and compatible immunoassay procedures. General techniques to be used in performing the various immunoassays noted above are known to those of ordinary skill in the art.

In the case of polypeptides which are secreted from cells, the level of expression of these polypeptides may be measured in biological fluids.

Other methods of screening for hematopoietic stem cells include determining the activity of a protein encoded by a gene selected from the Table 1 or Table 2 of the invention, and comparing the activity of said protein in a test cell with that in a control cell of the same type. The method of diagnosis may also comprise the steps of determining the level of turnover of a protein, the translational level of a protein, or the level of turnover of an mRNA encoded by a gene listed in Table 1 or Table 2 of the present invention. Assays to determine the activity of a particular protein, turnover levels, and translational levels are routinely used in the art, are well-known to

6.3. Data Analysis Methods

Comparison of the expression levels of one or more genes differentially expressed is preferably conducted using computer systems. In one embodiment, expression levels are obtained in two different cell populations and these two sets of expression levels are introduced into a computer system for comparison. In another embodiment, one set of expression levels is entered into a computer system for comparison with values that are already present in the computer system, or in computer-readable form that is then entered into the computer system.

In one embodiment, the invention provides a computer readable form of the gene expression profile data of the invention, or of values corresponding to the level of expression of at least one gene over- or under-represented in a the $CD34^+/CD38^-/Lin^-$ HSC. The values may be MRNA expression levels obtained from experiments, e.g., microarray analysis. The values may also be mRNA levels normalized relative to a reference gene whose expression is constant in numerous cells under numerous conditions, e.g., GAPDH. In other embodiments, the values in the computer are ratios of, or differences between, normalized or non-normalized mRNA levels in different samples.

The gene expression profile data may be in the form of a table, such as an Excel table. The data may be alone, or it may be part of a larger database, e.g., comprising other expression profiles. For example, the expression profile data of the invention may be part of a public database. The computer readable form may be in a computer. In another embodiment, the invention provides a computer displaying the gene expression profile data.

In one embodiment, the invention provides a method for determining the similarity between the level of expression of one or more genes differentially expressed in a sample of cells being analyzed, and entering these values into a computer comprising a database including records comprising values corresponding to levels of expression of one or more genes whose expression is characteristic of the $CD34^+/CD38^-/Lin^-$ HSCs. The database may further comprise processor instructions, e.g., a user interface, capable of receiving a selection of one or more values for comparison purposes with data that is stored in the computer. The computer may further comprise a means for converting the comparison data into a diagram or chart or other type of output.

In one embodiment, the invention provides a system that comprises a means for receiving gene expression data for one or a plurality of genes; a means for comparing the gene expression data from each of said one or plurality of genes to a common reference frame; and a means for presenting the results of the comparison. This system may further comprise a means for clustering the data.

In another embodiment, the invention provides a computer program for analyzing gene expression data comprising (i) a computer code that receives as input gene expression data for a plurality of genes and (ii) a computer code that compares said gene expression data from each of said plurality of genes to a common reference frame.

The invention also provides a machine-readable or computer-readable medium including program instructions for performing the following steps: (i) comparing a plurality of values corresponding to expression levels of one or more genes differentially expressed in a purified population of HSCs with a database including records comprising reference expression or expression profile data of one or more reference the $CD34^+/CD38^-/Lin^-$ HSCs and an annotation of the type of cell; and (ii) indicating as to whether the query cell is most similar to the $CD34^+/CD38^-/Lin^-$ HSC based on similarities of expression profiles.

The relative abundance of a mRNA in two biological samples may be scored as a perturbation and its magnitude determined (i.e., the abundance is different in the two sources of mRNA tested), or as not perturbed (i.e., the relative abundance is the same). In various embodiments, a difference between the two sources of RNA of at least a factor of about 25% (RNA from one source is 25% more abundant in one source than the other source), more usually about 50%, even more often by a factor of about 2 (twice as abundant), 3 (three times as abundant) or 5 (five times as abundant) is scored as a perturbation. Perturbations may be used by a computer for calculating and expression comparisons.

Preferably, in addition to identifying a perturbation as positive or negative, it is advantageous to determine the magnitude of the perturbation. This may be carried out, as noted above, by calculating the ratio of the emission of the two fluorophores used for differential labeling, or by analogous methods that will be readily apparent to those of skill in the art.

In operation, the means for receiving gene expression data, the means for comparing the gene expression data, the means for presenting, the means for normalizing, and the means for clustering within the context of the systems of the present invention may involve a programmed computer with the respective functionalities described herein, implemented in hardware or hardware and software; a logic circuit or other component of a programmed computer that performs the operations specifically identified herein, dictated by a computer program; or a computer memory encoded with executable instructions representing a computer program that may cause a computer to function in the particular fashion described herein.

Those skilled in the art will understand that the systems and methods of the present invention may be applied to a variety of systems, including IBM-compatible personal computers running MS-DOS or Microsoft Windows.

The computer may have internal components linked to external components. The internal components may include a processor element interconnected with a main memory. The computer system may be an Intel Pentium®-based processor of 200 MHz or greater clock rate and with 32 MB or more of main memory. The external component may comprise a mass storage, which may be one or more hard disks (which are typically packaged together with the processor and memory). Such hard disks are typically of 1 GB or greater storage capacity. Other external components include a user interface device, which may be a monitor, together with an inputing device, which may be a "mouse", or other graphic input devices, and/or a keyboard. A printing device may also be attached to the computer.

Typically, the computer system is also linked to a network link, which may be part of an Ethernet link to other local computer systems, remote computer systems, or wide area communication networks, such as the Internet. This network link allows the computer system to share data and processing tasks with other computer systems.

Loaded into memory during operation of this system are several software components, which are both standard in the art and special to the instant invention. These software components collectively cause the computer system to function according to the methods of this invention. These software components are typically stored on a mass storage. A software component represents the operating system, which is responsible for managing the computer system and its network interconnections. This operating system may be, for example, of the Microsoft Windows' family, such as Windows 95, Windows 98, or Windows NT. A software component represents common languages and functions conveniently present on this system to assist programs implementing the methods specific to this invention. Many high or low level computer languages may be used to program the analytic methods of this invention. Instructions may be interpreted during run-time or compiled. Preferred languages include C/C++, and JAVA®. Most preferably, the methods of this invention are programmed in mathematical software packages which allow symbolic entry of equations and high-level specification of processing, including algorithms to be used, thereby freeing a user of the need to procedurally program individual equations or algorithms. Such packages include Matlab from Mathworks (Natick, Mass.), Mathematica from Wolfram Research (Champaign, Ill.), or S-Plus from Math Soft (Cambridge, Mass.). Accordingly, a software component represents the analytic methods of this invention as programmed in a procedural language or symbolic package. In a preferred embodiment, the computer system also contains a database comprising values representing levels of expression of one or more genes whose expression is characteristic of HSC's.

In an exemplary implementation, to practice the methods of the present invention, a user first loads expression profile data into the computer system. These data may be directly entered by the user from a monitor and keyboard, or from other computer systems linked by a network connection, or on removable storage media such as a CD-ROM or floppy disk or through the network. Next the user causes execution of expression profile analysis software which performs the steps of comparing and, e.g., clustering co-varying genes into groups of genes.

In another exemplary implementation, expression profiles are compared using a method described in U.S. Pat. No. 6,203,987. A user first loads expression profile data into the computer system. Geneset profile definitions are loaded into the memory from the storage media or from a remote computer, preferably from a dynamic geneset database system, through the network. Next the user causes execution of projection software which performs the steps of converting expression profile to projected expression profiles. The projected expression profiles are then displayed.

In yet another exemplary implementation, a user first leads a projected profile into the memory. The user then causes the loading of a reference profile into the memory. Next, the user causes the execution of comparison software which performs the steps of objectively comparing the profiles.

7. Exemplary Diagnostic and Prognostic Compositions and Uses of the Invention 7.1. Methods of Isolating Pure HSC Populations for Transplantation Set forth above are exemplary methods of the invention which may be used to determine the differential expression of one or more genes in freshly purified and/or cultured HSC-substantially enriched populations to isolate a purified cell population that is substantially enriched in the $CD34^+/CD38^-/Lin^-$ HSCs and capable of reconstituting hematopoiesis in subjects in need thereof. This may be accomplished by providing a cell suspension of bone marrow, umbilical cord blood or mobilized peripheral blood cells and enriching the cell population using methods described herein for the $CD34^+/CD38^-/Lin^-$ cells.

In one embodiment, the gene expression profile of such populations may be determined by reverse transcription-polymerase chain reaction (RT-PCR); dotblot analysis; Northern blot analysis and in situ hybridization. In a preferred embodiment, the gene expression is determined by using a microarray which contains probes of the genes that are over- or under-represented in the $CD34^+/CD38^-/Lin^-$ HSC-substantially enriched populations as compared to the $CD34^+/CD38^+/Lin^+$ HPC-enriched populations. In another embodiment, the level of protein encoded by one or more of the genes that are over- or under-represented in the $CD34^+/CD38^-/Lin^-$ HSC-substantially enriched populations as compared to the $CD34^+/CD38^+/Lin^+$ HPC-enriched populations is determined. This may be done by a variety of methods, e.g., immunohistochemistry. The gene expression profile of the HSC population should have a similar expression profile to that of the $CD34^+/CD38^-/Lin^-$ HSC-substantially enriched populations of the invention. Thus the methods of the invention may be used to ensure that the HSC population enriched using the methods described herein or methods known to one skilled in the art is enriched by at least 2-fold, 5-fold, 10-fold, 50-fold, 100-fold, 500-fold, 1000-fold or more in the $CD34^+/CD38^-/Lin^-$ hematopoietic stem cells.

More highly-purified hematopoietic stem cell populations that are obtained in this manner are crucial for transplantation purposes as it is necessary to transplant only cell populations that are free of diseased cells (e.g., occult tumor cells) to avoid re-introduction of the disease in autologous BMT in a patient already suffering from disorders listed below. Once identified within a the $CD34^+/CD38^-/Lin^-$ substantially enriched cell population, contaminating tumor cells may be removed from a sample using further purification steps. Some metastatic tumor cells express hematopoietic lineage markers or antigens, for example, tumor cells from B-lymphomas, multiple myeloma, some chronic lymphocytic leukemias (CLL), and some acute lymphocytic leukemias (ALL) express B-cell markers such as CD22, CD20, CD29, and T cells from ALL and CLL express T-cell markers, and antibodies to these antigens may be included in the antibody compositions of the invention to remove tumor cells expressing the hematopoietic lineage antigens to recover a cell preparation which is further enriched in normal human hematopoietic stem cells and depleted of tumor cells.

The compositions and methods of the invention may be used in the processing of biological samples including blood in particular, cord blood, whole blood, mobilized peripheral blood stem-progenitor cells and bone marrow. The methods of the invention are preferably used to deplete or purge erythrocytes, B and T lymphocytes, monocytes, NK cells, granulocytes, and/or tumor cells from samples to prepare hematopoietic stem cell preparations for use in transplantation as well as other therapeutic methods that are readily apparent to those of skill in the art. For example, such cell populations can be administered directly by I.V. to a patient requiring a bone marrow transplant in an amount sufficient to reconstitute the patient's hematopoietic and immune system. Precise, effective quantities can be readily determined by those skilled in the art and will depend, of course, upon the exact condition being treated by the therapy. In many applications, however, an amount containing approximately the same number of stem cells found in one-half to one liter of aspirated marrow should be adequate. Bone marrow or blood can be harvested from a donor in the case of an allogenic transplant and substantially enriched for progenitor and stem cells by the processes described herein. In a preferred embodiment, allogenic transplantation of said population of stem cells purified by the methods of this invention will additionally prevent GHVD from occurring in the subject receiving the transplant. The purified hematopoietic stem cell population obtained by the methods of the invention may also be stored in a frozen viable state in the event the subject suffers a relapse.

Disorders that can be treated by infusion of stem cells include but are not limited to five broad categories. First are diseases resulting from a failure or dysfunction of normal blood cell production and maturation (i.e., aplastic anemia and hypoproliferative stem cell disorders). The second group are neoplastic, malignant diseases in the hematopoietic organs (e.g., leukemias, lymphomas, myelomas). The third group of disorders comprises those of patients with a broad spectrum of malignant solid tumors of non-hematopoietic origin. Stem cell infusion in these patients serves as a bone marrow rescue procedure, which is provided to a patient following otherwise lethal chemotherapy or irradiation of the patient, designed to eliminate malignant tumor cells. The fourth group of diseases consists of autoimmune conditions, where the stem cells serve as a source of replacement of an abnormal immune system. The fifth group of diseases comprises a number of genetic disorders which can be corrected by infusion of hematopoietic stem cells, preferably syngeneic, which prior to transplantation have undergone gene therapy. Particular diseases and disorders which can be treated by hematopoietic reconstitution with substantially enriched population of hematopoietic stem cells include but are not limited to those listed here: Diseases resulting from a failure or dysfunction of normal blood (cell production and maturation, hyperproliferative stem cell disorders, aplastic anemia, pancytopenia, agranulocytosis, thrombocytopenia, red cell aplasia, Blackfan-Diamond syndrome, due to drugs, radiation, or infection, idiopathic); Hematopoietic malignancies (acute lymphoblastic (lymphocytic) leukemia, chronic lymphocytic leukemia, acute myelogenous leukemia, chronic myelogenous leukemia, acute malignant myelosclerosis, multiple myeloma, polycythemia vera, agnogenic myelometaplasia, Waldenstrom's macroglobulinemia, Hodgkin's lymphoma, non-Hodgkins's lymphoma); Malignant, solid tumors (malignant melanoma, carcinoma of the stomach, ovarian carcinoma, breast carcinoma, small cell lung carcinoma, retinoblastoma, testicular carcinoma, glioblastoma, rhabdomyosarcoma, neuroblastoma, Ewing's sarcoma, lymphoma); Autoimmune diseases (rheumatoid arthritis, diabetes type I, chronic hepatitis, multiple sclerosis, systemic lupus erythematosus); Genetic (congenital) disorders (anemias, familial aplastic, Fanconi's syndrome, Bloom's syndrome, pure red cell aplasia (PRCA), dyskeratosis congenita, Blackfan-Diamond syndrome, congenital dyserythropoietic syndromes I-IV, Schwachmann-Diamond syndrome, dihydrofolate reductase deficiencies, formamino transferase deficiency, Lesch-Nyhan syndrome, congenital spherocytosis, congenital elliptocytosis, congenital stomatocytosis, congenital Rh null disease, paroxysmal nocturnal hemoglobinuria, G6PD (glucose-6-phosphate dehydrogenase) variants 1, 2, 3, pyruvate kinase deficiency, congenital erythropoietin sensitivity deficiency, sickle cell disease and trait, thalassemia alpha, beta, gamma, met-hemoglobinemia, congenital disorders of immunity, severe combined immunodeficiency disease (SCID), bare lymphocyte syndrome, ionophore-responsive combined immunodeficiency, combined immunodeficiency with a capping abnormality, nucleoside phosphorylase deficiency, granulocyte actin deficiency, infantile agranulocytosis, Gaucher's disease, adenosine deaminase deficiency, Kostmann's syndrome, reticular dysgenesis, congenital leukocyte dysfunction syndromes) and Others (osteopetrosis, myelosclerosis, acquired hemolytic anemias, acquired immunodeficiencies, infectious disorders causing primary or secondary, immunodeficiencies, bacterial infections (e.g., Brucellosis, Listerosis, tuberculosis, leprosy), parasitic infections (e.g., malaria, Leishmaniasis), fungal infections, disorders involving disproportions in lymphoid cell sets and, impaired immune functions due to aging, phagocyte disorders, Kostmann's agranulocytosis, chronic granulomatous disease, Chediak-Higachi syndrome, neutrophil actin deficiency, neutrophil membrane GP-180 deficiency, metabolic storage diseases, mucopolysaccharidoses, mucolipidoses, miscellaneous disorders involving immune mechanisms, Wiskott-Aldrich Syndrome, alpha 1-antitrypsin deficiency).

7.2. Methods of Diagnosing Leukemia or Lymphoma

In other embodiments, the level of expression of one or more genes in a tissue sample from a subject having or suspected of having leukemia or lymphoma, may be determined using the methods described herein. In one embodiment, samples of blood or bone marrow cells may be obtained from said patients through means known to persons skilled in the art. In a preferred embodiment, the level of expression of one or more genes in the tissue sample from the patient is compared to the level of expression of one or more genes in a normal the $CD34^+/CD38^-/Lin^-$ HSC-substantially enriched population by using a microarray which contains probes of the genes that are over- or under-represented in the $CD34^+/CD38^-/Lin^-$ HSC-substantially enriched populations. By comparing the profile of genes expressed in the patient's cells with the profile of genes expressed in the normal the $CD34^+/CD38^-/Lin^-$ substantially enriched stem cell population, one may determine if the patient's cells appear to be identical or closely similar to normal the CD34+/CD38−/Lin− versus a totally different type(s) of cells that may reflect disease, such as leukemia. If the different, disordered expression profile of the cells from the patient having leukemia or lymphoma does not match that of the profile of genes differentially expressed in the $CD34^+/CD38^-/Lin^-$ substantially enriched stem cell population (as listed in Table 1 and 2), the patient may be subjected to further treatment to completely eradicate such cells. The method as described above may provide a more sensitive means of diagnosing remission and or relapse in patients suffering from hematologic malignancies who have completed their course of traditional or experimental treatment, i.e. chemotherapy and/or radiotherapy.

This method of gene profiling may be performed on subjects who have not been diagnosed with leukemia or lymphoma but exhibit symptoms of the disease for diagnosis purposes.

7.3. Methods of Determining Optimal Time to Harvest HSCS from Blood

In another embodiment, the gene profiling methods of the invention may be used to determine the optimal time to harvest growth-factor-mobilized peripheral blood stem-progenitor cells (PBSC) in those instances when obtaining HSCs from bone marrow or cord blood may not be feasible or preferable. Peripheral blood stem cell transplants is also a commonly used alternative source of HSCs available for harvest transplant grafts from unrelated donors and patients. Currently, most PBSC transplants are autologous—cells are removed from a patient, stored as the patient receives high-dose therapy, and reinfused into the same patient. In the setting of related-donor (sibling) transplants, PBSCs are gradually replacing marrow as the preferred source of transplant material. In settings where the recipient is unrelated to the donor, PBSC transplants are generally performed only when a second donation is needed to counter graft rejection, as the recipient's body rejects donated marrow; or when engraftment does not continue, that is, the transplanted hematopoietic stem cells simply fail to grow and produce new blood cells (http://www.nih.gov/news/NIH-Record/10_21_97/story01.htm). However, these clinical practices are evolving, and all three tissue sources (i.e., bone marrow, cord blood, PBSC) are considered as therapeutic options for certain clinical situations or individual patients or allograft donors.

The PBSC transplant procedure begins when the donor is injected with a growth factor (usually granulocyte macrophage colony stimulating factor (GM-CSF) or Granulocyte Colony Stimulating Factor (G-CSF)), which causes hematopoietic stem cells to multiply and be released from the marrow into the blood stream. This is done because HSCs normally present in peripheral blood circulate in much lower concentrations than in bone marrow. The relatively small number of HSCs found in peripheral blood before the growth factor is given makes it difficult to collect enough cells for a successful transplant. The donor or patient, therefore, is injected with the growth factor for 5 consecutive days.

In one embodiment, samples of blood may be obtained from said patient or donor through means known to persons skilled in the art after 1-3, 4-6, 7-9, 10-12, 12-14 days after the growth factors are administered. In a preferred embodiment, the profile of expression of one or more genes in the cells of the blood sample may be compared to the profile of expression of one or more genes in a the CD34$^+$/CD38$^-$/Lin$^-$ HSC-substantially enriched population by using for example, a microarray which contains probes of the genes that are over- or under-represented in the CD34$^+$/CD38$^-$/Lin$^-$ HSC-substantially enriched populations. By comparing and quantitating the profile of genes expressed in such cells with the profile of genes differentially expressed in the CD34$^+$/CD38$^-$/Lin$^-$ substantially enriched stem cell population, one may determine when an optimal number of primitive hematopoietic stem cells has been produced or released into the peripheral blood. From this, one may then determine the optimal time to harvest such hematopoietic stem cells from the donor or the patient using a nonsurgical process or any other process known to those skilled in the medical arts.

In another embodiment, cells are incubated in culture after being isolated from their source, such as a donor or patient. This incubation period, which may last as short as a few hours to as long as a few days, is intended to allow the cells to recover from the stress and trauma associated with their isolation from the host. During the incubation period, one may compare and quantify the profile of genes expressed in such cells with the profile of genes differentially expressed in the CD34$^+$/CD38$^-$/Lin$^-$ substantially enriched stem cell population, to determine when an optimal number of hematopoietic stem cells has been produced in the culture. The incubation period may range from about 10-20 hours, 20-30 hours, 30-40 hours, 40-50 hours, 50-60 hours, 60-70 hours or 70-80 hours.

7.4. Methods of Screening

The present invention further relates to the use of the novel panels of genes listed in Tables 1 and 2 in methods of screening for candidate agents for use in inhibiting or stimulating hematopoiesis, survival, self-renewal, and/or migration/adhesion capabilities of HSCs. The candidate agents may be selected, for example, from the following classes of compounds: proteins, peptides, peptidomimetics, small molecules, cytokines, or hormones. In other embodiments, candidate agents are evaluated for their ability to bind a target gene. The candidate agents may be selected, for example, from the following classes of compounds: antisense nucleic acids, small molecules, polypeptides, proteins, peptidomimetics, or nucleic acid analogs. In some embodiments, the candidate agents may be in a library of compounds. These libraries may be generated using combinatorial synthetic methods. HSCs can be incubated with various concentrations of a test compound. In an illustrative embodiment, differentiated cells may be plated in the wells of a multi-well plate to which different concentrations of the test compound are added, e.g., 0 µM; 0.01 µM; 0.1 µM; 1 µM; 10 µM; 100 µM; 1 mM; 10 mM and 100 mM. Cells can be incubated for various times, e.g., 1 minute, 10 minutes, 1 hour, 2 hours, 5 hours, 10 hours, 24 hours, 36 hours or more. In certain embodiments of the present invention, the ability of said candidate agent to bind a target protein may be evaluated by an in vitro assay. In embodiments of the invention where the target of the candidate therapeutics is a gene, the ability of the candidate agent to bind the gene may be evaluated by an in vitro assay. In either embodiment, the binding assay may also be in vivo.

In order to assess the effect of a test agent on hematopoietic stem cell differentiation for example, the agent may be contacted with the hematopoietic stem cells and the HSCs assessed using methods as previously described for changes to the expression of genes as listed in Table 1 or Table 2.

7.5. Methods of Differentiating Hematopoietic Stem Cell-substantially Enriched Populations Obtained by Methods of the Invention Alternatively, isolated and purified hematopoietic stem cell substantially enriched populations with gene expression profile of the CD34$^+$/CD38$^-$/Lin$^-$ HSC-substantially enriched population as described in Table 1 and 2 may be contacted with various growth factors (termed differentiation factors) that influence differentiation of such stem cells into particular cell types such as hepatocytes, endothelial cells, muscle and neural cells for a sufficient period of time. As used herein, the phrase "a sufficient period of time" may range from at least 1-24 hours, 1-2 days, 2-4 days, 4-10 days or 10-14 days.

Hematopoietic stem cells isolated by the methods of the invention may be induced to differentiate into hepatocytes by culturing the cells under appropriate conditions and for a sufficient period of time. As used herein the term "hepatocyte differentiation promoting conditions" refers to culture of hematopoietic stem cells until the desired phenotype emerges. For example, HSCs may be cultured in media that include a hepatocyte differentiation factor such as epidermal growth factor EGF (0.1-100 ng/ml); dexamethasone (0.1-100 µM); hepatocyte growth factor HGF (0.1-100 ng/ml); insulin (0.1-100 µg/ml), transferrin (0.1-100 µg/ml), selenium (0.1-100 ng/ml, ethanolamine (0.1-100 µg/ml), phenobarbital (1 mM), Type-I collagen. Culturing HSCs in the presence of growth factors promotes undifferentiated cells to differentiate and display the phenotype of differentiated cells. The phenotype of the differentiated cells can be determined by measuring the presence of particular markers that have been defined to be present in a particular differentiated cell. The term "hepatocytes" as used herein refers to cells that have characteristics of epithelial cells obtained from liver. Hepatocytes are cells that express markers such as asialoglycoprotein receptor (ASGR), alpha-1-antitrypsin (A1AT), albumin, hepatocyte nuclear factors (HNF1 and HNF4) and cytochrome P450 (CYP) genes (1A1, 1A2, 2A6, 2B6, 2C8, 2C9, 2C18, 2C38, 2D6, 3A4, 3A5, 3A7, 4A11). interest for hepatocytes include α1-antitrypsin, glucose-6-phosphatase, transferrin, cytokeratin 7 (CK7), γ-glutamyl transferase; hepatocyte nuclear factors (HNF 1β, HNF 3α, HNF-4α), transthyretin, cystic fibrosis transmembrane conductance regulator (CFTR), glucokinase, insulin growth factors (IGF)

1 and 2, IGF-1 receptor, insulin receptor, leptin, apolipoproteins (apoE, apoAII, apoB, apoCIII, apoCII), aldolase B, phenylalanine hydroxylase, L-type fatty acid binding protein, transferrin, retinol binding protein, erythropoietin (EPO), carnitine palmitoyltransferase (CPT), aldo-keto reductase 1 and clotting factors, such as Factor V, VII, VIII, IX and X. These cells could be used as a part of a therapy for patients suffering from a deficiency or loss of function of hepatocytes. Additionally, such cells could be used as gene delivery devices in gene therapy.

Hematopoietic stem cells isolated by the methods of the invention can be differentiated into endothelial cells by culturing the cells under appropriate conditions and for a sufficient period of time. As used herein the term "endothelial cell differentiation promoting conditions" refers to culture of hematopoietic stem cells until the desired phenotype emerges. For example, HSCs may be cultured in media that include an endothelial cell differentiation factor, such as Matrigel™, vascular endothelial growth factor (VEGF), fibroblast growth factor-1 (FGF-1), fibroblast growth factor-2 (FGF-2), platelet-derived endothelial cell growth factor (PD-ECGF), and platelet-derived growth factor (PDGF) in concentrations ranging from about 0.1 to 10,000 ng/mL or from about 10-100 ng/ml. As used herein, endothelial cells refer to a thin, flattened cell, a layer of them lines the inside surfaces of body cavities, blood vessels, and lymph vessels, making up the endothelium. Endothelial cell may express a marker including but not limited to angiopoietin-1 (ANG-1), protein C receptor endothelial (PROCR/EPCR), vascular cell adhesion molecule-1 (VCAM-1), FMS-like tyrosine kinase 1 (FLT-1, also known as vascular endothelial growth factor (VEGF) receptor-1) and RGD (arginine-glycine-aspartic acid)-dependent integrins, including the vitronectin receptor ($alpha_v beta_3$ or $alpha_v beta_5$), the collagen Types I and IV receptor ($alpha_1 beta_1$), the laminin receptor ($alpha_2 beta_1$), the fibronectin/laminin/collagen receptor ($alpha_3 beta_1$) and the fibronectin receptor (Davis et al., *J. Cell. Biochem.* 51:206-218 (1993)). These cells could be used as a part of a therapy for patients suffering from a deficiency or loss of function of endothelial cells. Additionally, such cells could be used as gene delivery devices in gene therapy.

Hematopoietic stem cells isolated by the methods of the invention can be differentiated into neural cells by culturing the cells under appropriate conditions and for a sufficient period of time. As used herein the term "neural cell differentiation promoting conditions" means culturing hematopoietic stem cells until the desired phenotype emerges. For example, HSCs may be cultured in media that include a neural cell differentiation factor such as erythropoietin (EPO), all trans retinoic acid, epidermal growth factor (EGF) (0.1-10 ng/ml), dexamethasone (0.1-100 µM), hepatocyte growth factor (HGF)(0.1-100 ng/ml), insulin (0.1-100 µg/ml)-transferrin (0.1-100 µg/ml)-selenium (0.1-100 ng/ml) (ITS), ethanolamine (0.1-100 µg/ml) and, in particular, with fibroblast growth factor 4 (FGF-4), preferably in the range of 10 ng/ml, nerve growth factor (NGF), transforming growth factor-alpha (TGF-alpha), brain-derived neurotrophic factor (BDNF), glial-derived neurotrophic factor (GDNF), acidic fibroblast growth factor (aFGF of FGF-1), basic fibroblast growth factor (bFGF or FGF2), leukemia inhibitory factor (LIF), platelet-derived growth factor (PDGF), ciliary neurotrophic factor (CNTF), neurotrophin-3, neurotrophin-4, amphiregulin, and Notch antagonists. As used herein "neural cells" refer to cells that exhibit essential functions of neurons, and glial cells (astrocytes and oligodendrocytes). Preferred neural cells express at least one neural cell specific marker such as ANA/BTG3, Neuronal Growth-Inhibitory Factor (GIF/TIEG), survival motor neuron gene (SMN1), nestin, neuron specific enolase (NSE), neurofilament-M (NF-M), beta-tubulin, C-type natriuretic peptide (CNP), glutamic acid decarboxylase (GAD), tau, microtubule-associated protein 2a and b (MAP2), neurogenin, neuron specific nuclear protein (Neu N), a Hu protein (A, B, C, D), glial fibrillary acid protein (GFAP), oligodendrocyte marker 4 (O4), galactocerebroside (GalC), or myelin basic protein (MBP). These cells could be used as a part of a therapy for patients suffering from a deficiency or loss of function of neural cells. Additionally, such cells could be used as gene delivery devices in gene therapy.

Hematopoietic stem cells isolated by the methods of the invention can be differentiated into muscle cells under appropriate conditions and for a sufficient period of time. As used herein the term "muscle cell differentiation promoting conditions" means culturing hematopoietic stem cells until the desired phenotype emerges. For example, HSCs may be cultured in media that include a muscle cell differentiation factor such as transforming growth factor-beta (TGF-beta), bone morphogenic protein 2 (BMP-2) or BMP-4 in concentrations ranging from about 0.1 to 10,000 ng/mL or from about 10-100 ng/ml. As used herein, the term "muscle cell" is intended to encompass a cell of muscle tissue. In striated (skeletal) muscle a muscle cell comprises a syncytium formed by the fusion of embryonic myoblasts, in cardiac muscle a muscle cell is linked to the others by specialized junctional complexes (intercalated discs), in smooth muscle a muscle cell is a single cell with large amounts of actin and myosin capable of contracting to a small fraction of its resting length. Preferred muscle cells express at least one muscle cell specific marker such as the myocyte enhancer factor-2 (MEF-2) family of transcription factors, nebulin related anchoring protein (NRAP), cardiac myosin, -sarcomeric actin, desmin, connexin-43, N-cadherin, cardiac transcription factor-4 (GATA-4), GATA-5, nestin. or myoglobin. These cells could be used as a part of a therapy for patients suffering from a deficiency or loss of function of muscle cells. Additionally, such cells could be used as gene delivery devices in gene therapy.

To monitor the differentiation of HSCs to non-hematopoietic cell types, cells are incubated in culture after being isolated from their source, such as a donor or patient. During the incubation period, one may compare and quantify the profile of genes expressed in such cells with the profile of genes differentially expressed in the $CD34^+/CD38^-/Lin^-$ substantially enriched stem cell population. As the HSCs differentiate to non-hematopoietic cell types, HSCs should lose the gene expression pattern of HSCs and acquire the gene expression patterns of the differentiated cell type. Thus, as HSCs differentiate to muscle or neural cells, the cells should express the genes that encode the muscle- or neural cell-specific markers, respectively.

The hematopoietic stem cell substantially enriched populations obtained using the methods of the invention may also be used to isolate and evaluate factors associated with the maintaining and regulating the "stemness" of human hematopoietic stem cells. The cell preparations may also be used to determine the effect of a substance on the ability for self-renewal and the ability to generate daughter cells of any hematopoietic lineage.

The invention now being generally described, it will be more readily understood by reference to the following examples, which are included merely for purposes of illustration of certain aspects and embodiments of the present invention, and are not intended to limit the invention.

EXEMPLIFICATION

Example 1

Isolation of the CD34$^+$/CD38$^-$/Lin$^-$ and CD34$^+$/[CD38/Lin]++ cell populations Materials and Methods Cryopreserved human CB CD34$^+$ cells were purchased from AllCells (Berkeley, Calif.). Cryopreserved human cadavaric BM and PBSC CD34$^+$ cells from normal adult donors were obtained from the National Heart, Lung, and Blood Institute Program of Excellence in Gene Therapy, Hematopoietic Cell Processing Core (Fred Hutchison Cancer Center, Seattle, Wash.). Each BM sample was a pool of cells from two donors. One PBSC sample was a pool of five donors, the other a pool of three donors. The CB sample was a pool from >80 donors. Previous results in our laboratory have shown that an outlier in gene expression occurs at a frequency of less than 1 in 10-12 normal donors. Therefore, duplicate samples consisting of multiple donor pools were used to minimize the possibility that a rare outlier would affect the differential gene expression results. All human cells had been obtained with informed consent under institutional review board-approved protocols and were provided without data identifying the donors.

$5 \times 10^7$ frozen total CD34$^+$ cells were thawed and viable cells obtained by Ficoll-Hypaque density gradient centrifugation, resulting in $1.8$-$2.8 \times 10^7$ viable cells per sample. Viable cells were then stained with phycoerythrin (PE)-conjugated anti-human CD34 monoclonal antibody (Mab) and a cocktail of FITC-conjugated Mabs specific for human CD38 and the following lineage (Lin) markers: CD3 (T lymphoid cells), CD5 (T lymphoid cells), CD10 (lymphoid progenitor cells), CD13 (mature and progenitor-precursor macrophage/monocytic and granulocytic cells), CD14 (monocyte/macrophages), CD16 (granulocytes, NK cells, monocyte/macrophages), CD19 (mature and early B lymphoid cells), CD33 (mature and progenitor-precursor macrophage/monocytic and granulocytic cells), CD41 a (mature and progenitor-precursor platelets, megakaryocytic cells), CD45RA (B lymphoid cells, some T lymphoid cells, some mono/granulocytic progenitor-precursor cells), CD66B (granulocytic cells), CD71 (erythroid progenitor-precursor cells, activated lymphoid cells), and CD235a (glycophorin A; mature and precursor erythroid cells). All Mabs were purchased from BD Biosciences-Pharmingen (San Diego, Calif.) except CD13 (Dako, Denmark). Cells were isolated by fluorescence-activated cell sorting (FACS) using a FACSVantage flow cytometer (Becton-Dickinson, Franklin Lakes, N.J.).

Results $1.8$-$2.8 \times 10^7$ viable CD34$^+$ cells per sample were FACS-sorted. The average RNA content (~1.5 pg/cell) of both the CD34$^+$/CD38$^-$/Lin$^-$ and CD34$^+$/[CD38/Lin]$^{++}$ cells dictated a requirement for ~$10^6$ FACS-sorted cells per subpopulation to yield sufficient RNA for transcriptome analysis. Therefore, for these experiments, the 5-10% of cells with the lowest and the highest intensity of FITC fluorescence (corresponding to expression of the CD38/Lin marker cocktail) were sorted by FACS as the CD34$^+$/CD38$^-$/Lin$^-$ (HSC-enriched) and CD34$^+$/[CD38/Lin]$^{++}$ (HPC-enriched, HSC-depleted) cell preparations, respectively. This resulted in 8% of the cells from CB (a single FACS sort), 8.5% from BM (average of two sorts), and 9% from PBSC (average of two sorts) being isolated as the CD34$^+$/CD38$^-$/Lin$^-$ and CD34$^+$/[CD38/Lin]$^{++}$ cell populations. CB cells yielded 2 µg RNA for the CD34$^+$/CD38$^-$/Lin$^-$ and 2.3 µg for the CD34$^+$/[CD38/Lin]$^{++}$ cells; BM (average of two samples) 1.6 µg and 1.6 µg, and PBSC (average of two samples) 1.5 µg and 1.1 µg, respectively. FACS re-analyses of the starting CD34$^+$ cells and the FACS-sorted cells (shown for one of the FACS sorts for each tissue in FIG. S1) demonstrated that the purified cell populations were highly enriched for the specified phenotypes.

Example 2

Purification of Total RNA

Materials and Methods

After FACS, cells were pelleted by centrifugation at 800× g in RNase-free, 1.5 ml siliconized microcentrifuge tubes (Ambion, Austin, Tex.). Pellets were disrupted by vigorous pipeting in 100 µl Trizol Reagent (Invitrogen, Carlsbad, Calif.) per 106 cells. This solution was transferred to 1.5 ml PhaseLoc-Heavy tubes (Eppendorf, Hamburg, Germany), 20 µl chloroform was added per 100 µl Trizol, and the tubes were centrifuged at maximum speed (~20,000× g) in a microcentrifuge. The aqueous phase containing RNA was removed and further purified using the RNeasy Mini-Kit (Qiagen, Valencia, Calif.) following the manufacturer's "RNA Clean-up" protocol with the optional "On-column DNase Treatment"; the only modification to the Qiagen protocols was that numbers of washes for all washing steps were doubled.

Example 3

Analysis of Gene Expression: Microarray Analysis of BM, CB, and PBSC

Materials and Methods

Five hundred ng total RNA from each sample was double linear amplified with the ENZO BioArray High Yield RNA Transcript Labeling Kit and the GeneChip Eukaryotic Small Sample Target Labeling Assay, Version II protocol (Affymetrix, Santa Clara, Calif.) to produce target for hybridization to Affymetrix U133 chips. Although 2× linear amplification of RNA is a commonly used and reliable method, we tested the fidelity of the method in preserving relative gene expression levels. RNA from total CD34$^+$ PBSC cells was compared to a reference RNA prepared from a control cell line. Five µg of each RNA was tested after standard 1× amplification, and 500 ng of each was tested after 2× amplification, by hybridization to the U133A chip. Fold change comparisons of each condition were then performed with Genespring 5.0.2 software (Silicon Genetics, Redwood City, Calif.). While there were minor changes in the absolute magnitude of change for a small number of genes, the directionality of change was different in <0.001% of the ~4,000 transcripts scored as present.

BM and PBSC samples were tested in biologic duplicate (i.e., samples from two different donor pools). The CB sample was tested in technical duplicate (i.e., same RNA donor pool analyzed twice). Initial quality assessments of duplicate samples were analyzed using Affymetrix MAS 5.0 software. In addition to the internal chip normalizations performed with Affymetrix chips, the U133 chips contain a set of 100 normalization genes (probe sets 200,000-200,099), which have been shown to be stably expressed across many different cell types; these normalization genes were used for additional normalization of all samples. Genespring 5.0.2 software was used for statistical analysis of differential transcript expression. In addition to the parametric statistical measures of gene expression provided by GeneSpring 5.0.2 and Affymetrix MAS 5.0, we used the nonparametric Hypothesis-based Analysis of Microarrays (HAM) method as a secondary filter applied to the experiment in the selection of over-represented genes. (Kowalski et al., (2004) *Bioinformatics in press* and Kowalski et al (2004) *Bioinformatics in press*). Filemaker Pro 6.0 software (Filemaker Inc, Santa Clara, Calif.) was used to build a gene expression database, to compare gene expression patterns, and to classify genes by functional category.

Gene/transcript annotation data was obtained by query of the Unigene, Locus Link, On-line Mendalian Inheritance in Man, and KEGG molecular pathway information databases (Kanehisa et al., (2002) *Nucleic Acids Res.*, 30:42-46). Percent identity between cell populations was calculated by the formula: Shared genes in population A and B (and C)/All genes expressed by population A or B (or C).

Results

The Transcriptome of CD34$^+$/CD38$^-$/Lin$^-$ Cells by Oligonucleotide Microarray Analysis The oligonucleotide microarray gene expression results for each of the three tissues were filtered with MAS 5.0 software to select only those genes scored as "Present" in the CD34$^+$/CD38$^-$/Lin$^-$ populations. 11849 transcripts were expressed by at least one of three HSC populations. 6366 transcripts were detected in the CD34$^+$/CD38$^-$/Lin$^-$ population from BM, 11075 from CB, and 6669 from PBSC (FIG. 1A). 4746 of these genes were expressed in the CD34$^+$/CD38$^-$/Lin$^-$ population of all three tissues; this group included 2943 transcripts of known function, 13 10 uncharacterized transcripts or ESTs, and 493 predicted transcripts. At the global gene expression level, the BM and CB populations share 50.4% identity, CB and PBSC share 54.9% identity, BM and PBSC share 59.7% identity. Overall the three populations share 40.1% identity at the level of transcriptome phenotype.

Figure 2A:
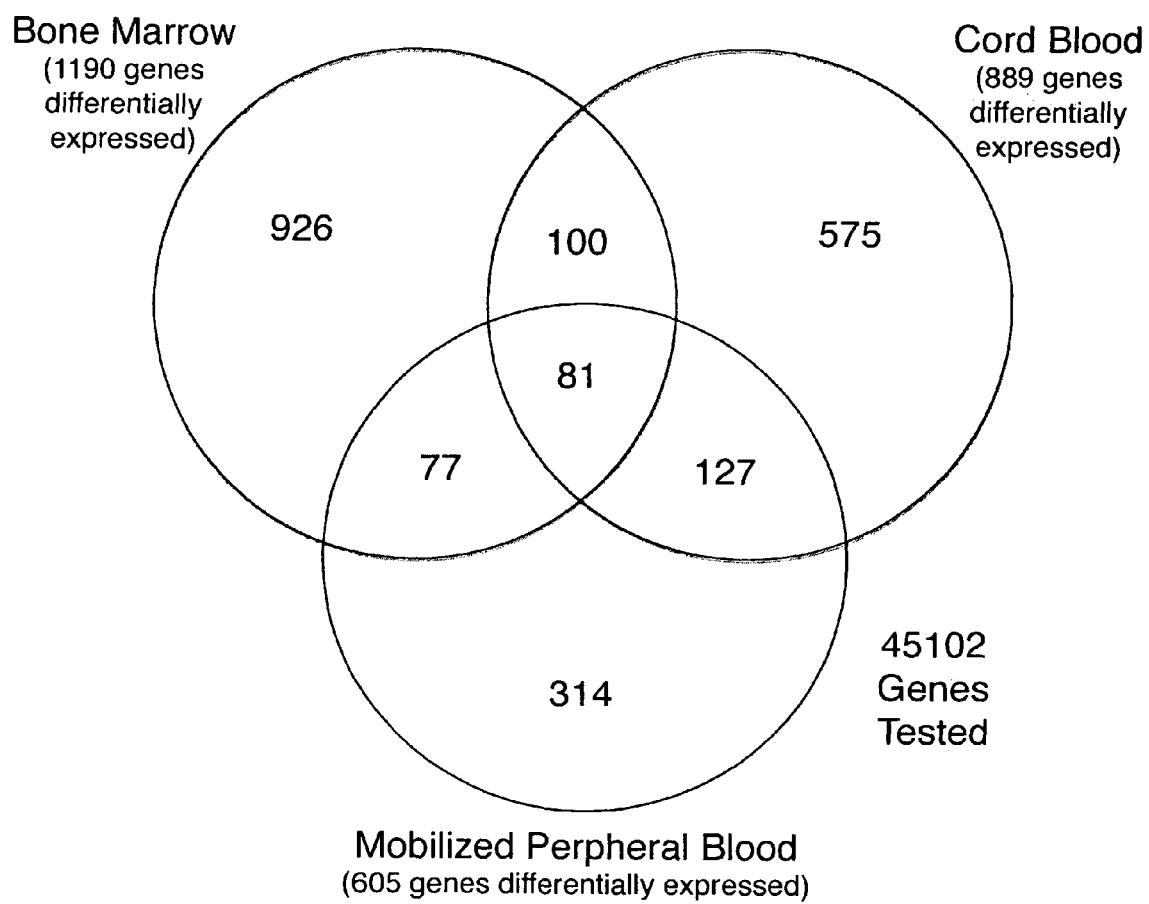
FIG. 2A is a Venn diagram depicting the numbers of genes over-represented in the CD34$^+$/CD38$^-$/Lin$^-$ population from one, two, and/or all three tissues compared to the CD34$^+$/[CD38/Lin]$^{++}$ population from BM, CB, and/or PBSC. Genes over-represented in the CD34$^+$/CD38$^-$/Lin$^-$ preparations from (A) all three tissues are listed in Table 1. Results from the U133 A and B chips were subjected to statistical analysis with GeneSpring 5.0.2 to generate p-values for the CD34$^+$/CD38$^-$/Lin$^-$ vs. the CD34$^+$/[CD38/Lin]$^{++}$ populations from each tissue. Only genes meeting the 90% confidence level for fold difference in transcript expression and greater than >2-fold over-represented in the CD34$^+$/CD38$^-$/Lin$^-$ population are included. Shown are genes over-represented in the CD34$^+$/CD38$^-$/Lin$^-$ populations from (B) BM, (C) CB, or (D) PBSC; from (E) BM and CB, from (F) BM and PBSC, or from (G) CB and PBSC.
Figure 2B:
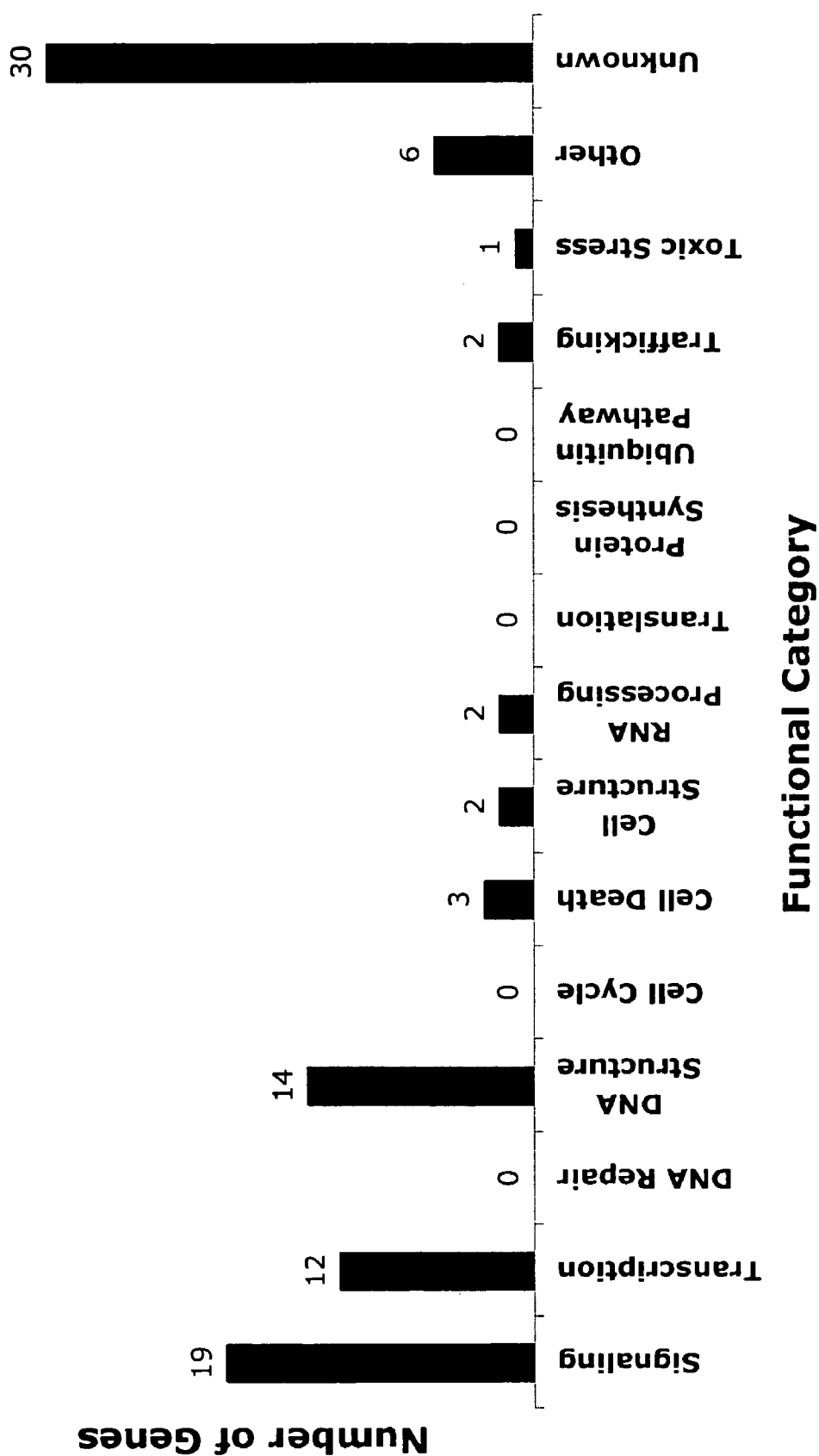
FIG. 2B is a bar graph showing the functional categorization of the 81 genes over-expressed in the CD34$^+$/CD38$^-$/Lin$^-$ populations from all three tissues, based on the GO classification system.
Figure 3A:
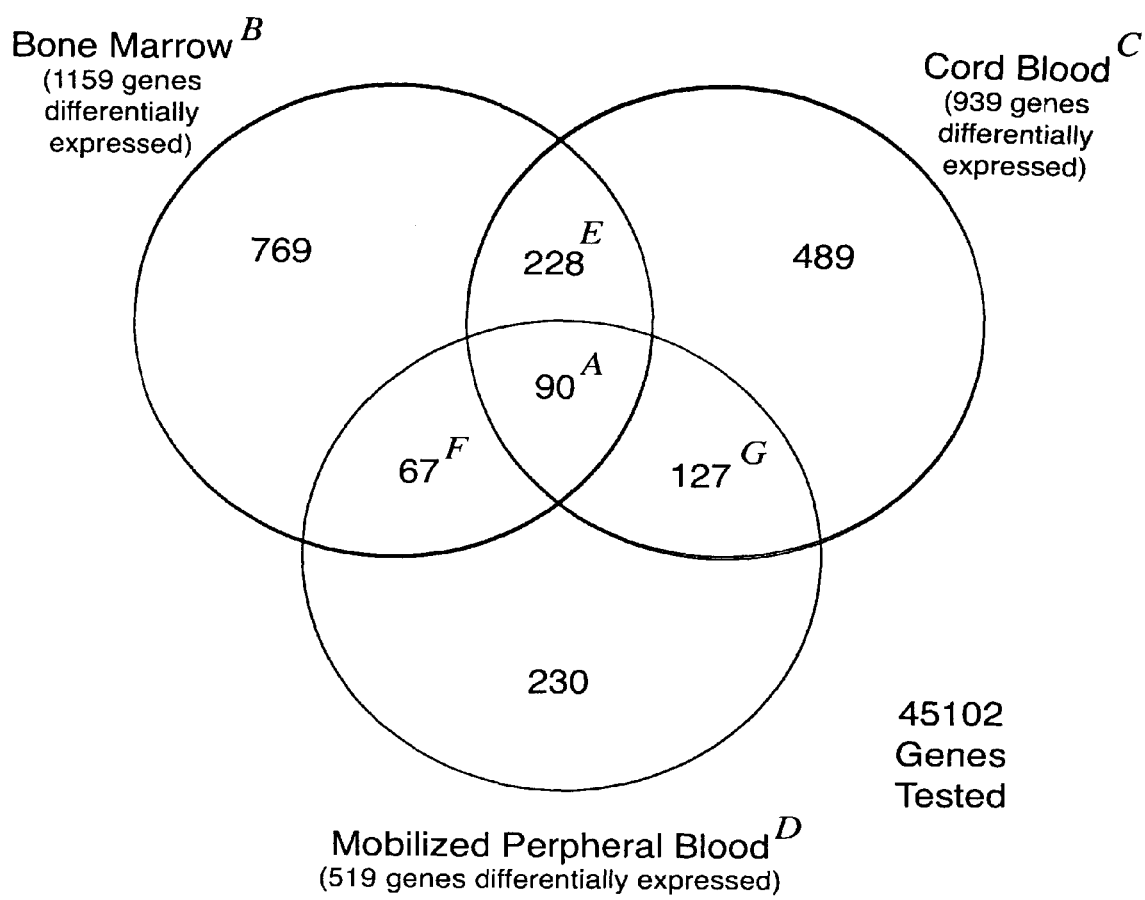
FIG. 3A is a Venn diagram depicting the numbers of genes under-represented in the CD34$^+$/CD38$^-$/Lin$^-$ population from one, two, and/or all three tissues compared to the CD34$^+$/[CD38/Lin]$^{++}$ population from BM, CB, and/or PBSC. Genes under-represented in the CD34$^+$/CD38$^-$/Lin$^-$ population from (A) all three tissues are listed in Table 2. Results were analyzed as in FIG. 2. Shown are genes over-represented in the CD34+/CD38−/Lin− populations from (B) BM, (C) CB, or (D) PBSC; from (E) BM and CB, from (F) BM and PBSC, or from (G) CB and PBSC.
Figure 3B:
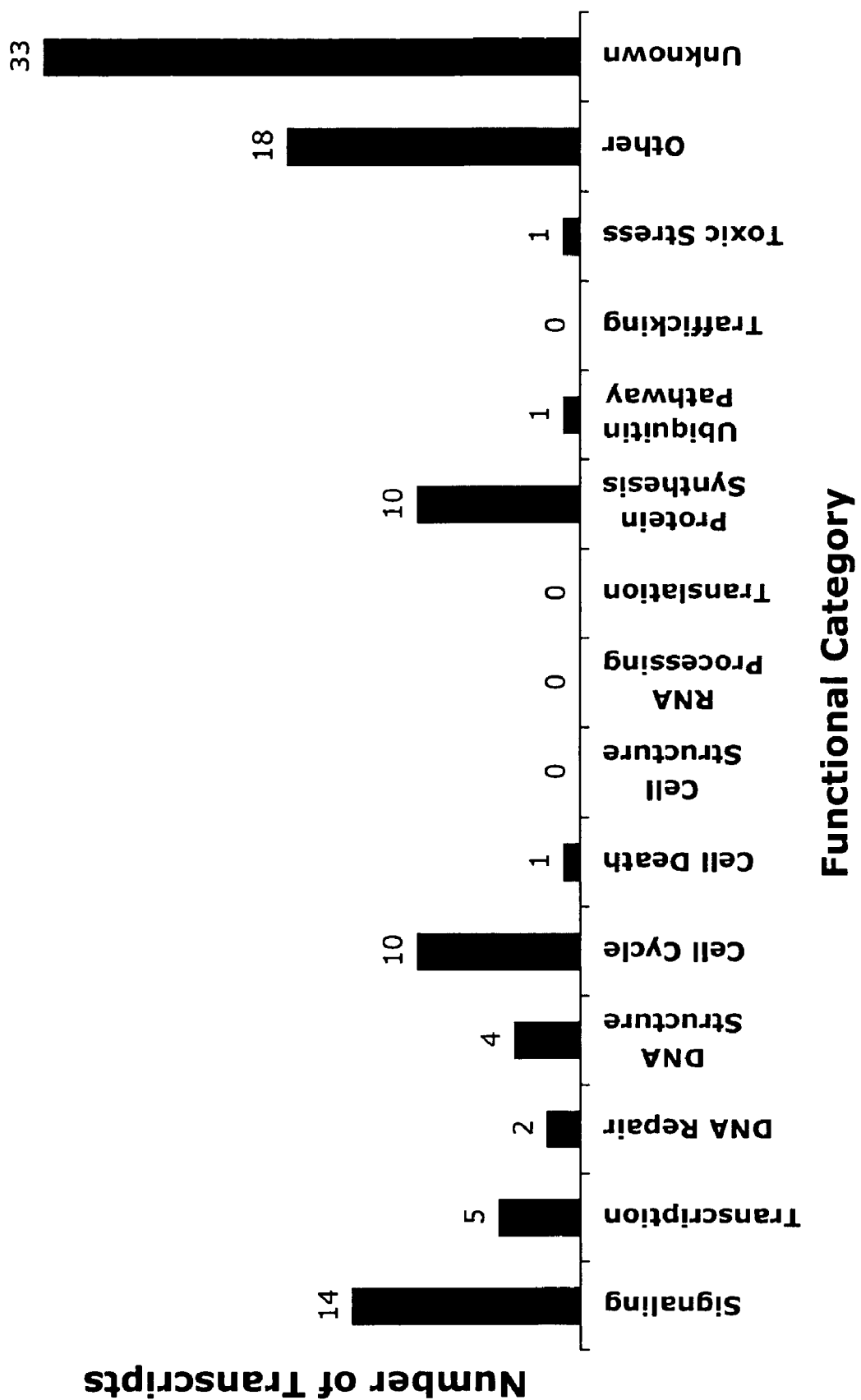
FIG. 3B is a bar graph showing the functional categorization of the 90 genes under-expressed in the CD34+/CD38−/Lin− populations from all three tissues, based on the GO classification system.

Microarray Analysis of the HSC-enriched (CD34$^+$/CD38$^-$/Lin$^-$) Transcriptome Compared to the HPC-enriched CD34$^+$/[CD38/Lin]$^{++}$ Transcriptome For each of the three tissues, differential expression lists of the microarray results were generated, using GeneSpring 5.0.2 software, of transcripts that were >2-fold differentially expressed and met the 90% confidence level, by Student's T-test, as significantly different in the CD34$^+$/CD38$^-$/Lin$^-$ HSC cell-enriched population, as compared to the CD34$^+$/[CD38/Lin]$^{++}$ HPC-enriched cell population from the same tissue (FIGS. 2A and 3A). The CD34$^+$/CD38$^-$/Lin$^-$ population from BM over-expressed 1190 transcripts and under-expressed 1159 transcripts, that from CB over-expressed 889 and under-expressed 939 transcripts, and that from PBSC over-expressed 506 and under-expressed 519 transcripts. Intersecting these results for all three tissues yielded 87 Affymetrix probe sets (representing 81 genes) comparatively over-represented (Table 1) and 95 Affymetrix probe sets (representing 90 genes) under-represented (Table 2) in the CD34$^+$/CD38$^-$/Lin$^-$ HSC-enriched compared to the C34$^+$/[CD38/Lin]$^{++}$ HPC-enriched population. These genes were also independently selected by the nonparametric, HAM method. Functional annotation of the HSC-over-represented genes (FIG. 2B) yielded 50 genes of known/predicted function and 30 genes of unknown function (including 12 ESTs and 7 predicted proteins). Annotation of the HSC-under-represented genes yielded 59 genes of known function and 31 genes of unknown function (including 15 ESTs and 8 predicted proteins)(FIG. 3B).

Example 4

Analysis of Gene Expression: SAGE of BM HSC-enriched and HPC-enriched Populations.

Materials and Methods

Eight hundred ng total RNA from the BM HSC-enriched and HPC-enriched populations was analyzed by Micro-SAGE. Micro-SAGE was carried out with the iSAGE kit (Invitrogen, Carlsbad, Calif,), modified to follow the Micro-SAGE protocol (Datson et al., (1999) *Nucleic Acid Res.*, 27:1300-1307). Sequencing of SAGE 10-mer tags of 2304 clones from each library was carried out by Agencourt Bioscience Corporation (Beverly, Mass.). SAGE tags were enumerated, annotated (with both the Reliable- and Full-SAGE tag mappings—see www.sagenet.org for a full description of these methods), and normalized with SAGE 2000 version 4.5 software (Invitrogen). Filemaker Pro 6.0 was used to build a gene expression data base from the tag data. Transcripts with a SAGE tag count of 1 were excluded from analysis, since erroneous tag sequences can be generated by sequencing errors, at a rate of ~1 per 500 tags. Since the odds of having two identical erroneous tags detected is ~1 per 100,000 tags, we considered any gene expressed at >2 tags to be "Present" by SAGE. There is no consensus statistical method (Man et al., (2000) *Bioinformatics* 16:953-959; Becquet et al., (2002) *Genome Biol.*, 3:RESEARCH0067; Ruijter et al., (2002) *Physiol Genomics.*, 11:37-44; van Ruissen et al., (2002) *Faseb J.*, 16:246-248) for addressing significant differences of expression between SAGE libraries; we chose the method of Man et al ((2000) *Bioinformatics* 16:953-959) to calculate P-values for expression differences between the libraries.

Results

The BM populations showed the greatest differences in gene expression between the HSC- and HPC-enriched populations. Therefore, this population was chosen for SAGE. 84,107 tags were detected from the HSC population library, and 87,416 tags from the HPC population library. Herein, we focused on only the genes identified as HSC-over-expressed genes by the microarray analyses. SAGE produced tags for 65 of the 81 transcripts which were over-expressed in HSCs by microarray analysis (Table 1). SAGE confirmed over-expression of 61 (94%) of these 65 genes found over-expressed by the HSC population. For 4 (6%) transcripts, SAGE showed similar expression in the HSC versus HPC population. SAGE did not detect non-redundant tags for 16 (20%) of the 81 transcripts (Table 1), making it impossible to determine expression of these transcripts by SAGE.

Overall, SAGE identified 10,078 transcripts expressed by BM HSC-enriched cells, about 58% more transcripts than the 6366 detected by microarray analysis. In addition, 2916 transcripts were over-expressed at least 2-fold in the BM HSC-enriched population by SAGE, compared to the 1190 transcripts identified as HSC-over-expressed by microarray analysis. Of these HSC-over-expressed transcripts identified by SAGE, 2008 were detected exclusively in the HSC population (i.e., they were completely absent in the HPC-enriched population). 646 tags detected by SAGE as expressed in HSCs, did not map to any known transcript or EST; of these, 408 tags were over-expressed in HSCs, and 238 of these 408 tags were detected exclusively in the HSC-enriched population (i.e., not detected in HPCs).

Example 5

Confirmation of Gene Expression

Materials and Methods

RNA sequences for differentially expressed transcripts were downloaded from GeneBank (www.ncbi.nlm.nih.gov/Genbank/). Multiple PCR primers for each transcript were designed with Primer 3.0 (Whitehead Institute, Massachusetts Institute of Technology, Boston, MA, www-genome.wi.mit.edu/cgi-bin/primer/primer3_www.cgi), and tested against a two-fold dilution series of test sample prepared by mixing cDNA from unsorted CD34$^+$ cells from BM, CB, and PBSC. We had previously determined that β-actin is an optimal normalization gene for calibration of qRT-PCR results among different CD34$^+$ cell populations. Two-step RT-PCR was carried out by first producing cDNA with a modified version of the Super-SMART PCR cDNA Kit (Clontech, Palo Alto, Calif.). Second, qRT-PCR was carried out on a Bio-Rad iCycler (Bio-Rad, Hercules, Calif.) with iQ SYBR-green Supermix (Bio-Rad, Hercules, Calif.). Only primer sets that produced a single product band (as shown by both agarose gel and melt-curve analysis) and that resulted in doubling efficiencies of nearly 100% were used for further analyses. This was imperative since the—ΔΔCt method (Livak et al., (2001) Methods 25:402-408) was used to calculated fold-difference in gene expression.

Results

Figure 5A:
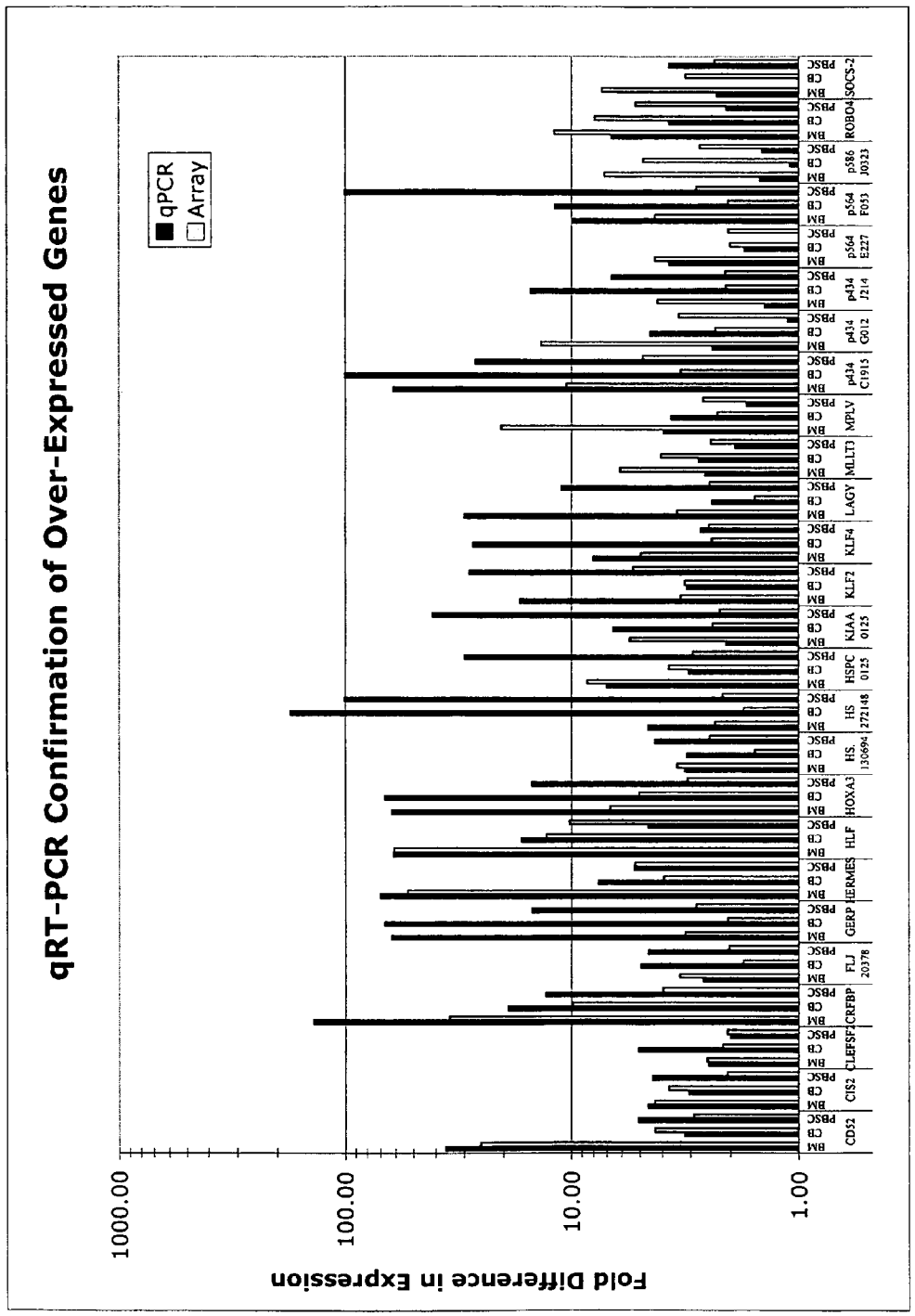
FIGS. 5A and B show a bar graph depicting qRT-PCR verification of select over- and under-represented genes as indicated by microarray analysis. Twenty-six transcripts from the (A) over-represented and seventeen transcripts from the (B) under-represented lists were selected for validation by quantitative real-time RT-PCR. For those genes over-expressed by the HSC, five that appeared to be transcription factors, the four highest expressed, and the remaining were chosen at random. This resulted in a panel of genes that included the spectrum of fold differences, ranging from 2-fold to 60-fold. For those the under-expressed, the tested genes were chosen at random.

Twenty-nine genes were chosen from the list of microarray HSC-over-represented (Table 1) and 19 genes from the list of HSC-under-represented (Table 2) genes for confirmation of fold-difference by relative qRT-PCR. Transcripts were chosen to cover the entire observed range of fold-differences, from 2-fold to the maximum of 60-fold. Expression levels of these 48 transcripts were tested in HSC- and HPC-enriched populations from all three tissues, for a total of 144 independent qPCR tests. 141 of these 144 qRT-PCR assays confirmed the observed differential expression in the CD34$^+$/CD38$^-$/Lin$^-$ HSC-enriched compared to the CD34$^+$/[CD38/Lin]$^{++}$ HPC-enriched cell population; there were only 3 transcripts where differential expression by microarray was not confirmed by qRT-PCR for all three tissues (FIGS. 5A and B). In each of these three cases, the analyses disagreed in only one tissue of the three tissues (and even in this one tissue, there was a difference in gene expression, but it did not meet the arbitrary two-fold cutoff). Therefore, an exceptional level of 98% qRT-PCR confirmation was achieved for microarray results in this study. Indeed, the magnitude of fold difference detected by qRT-PCR tended to be greater than those found by the microarrays for several of genes (e.g., CRFBP, LAGY, EDM, HTM4), most likely due to greater sensitivity of PCR, and agreed very closely for most others (e.g., CD52, HERMES, HLF, FKSG14).

By comparing the gene expression profiles of the purified CD34$^+$/CD38$^-$/Lin$^-$ cell population to that of the CD34$^+$/[CD38/Lin]$^{++}$ population from each of these three tissues, and then determining the genes identified as differentially expressed by the HSC in all three tissues ("Intersection Analysis"), we were able to focus more clearly on genes likely to be involved in HSC versus HPC function; i.e., since all three tissue populations contain HSCs which engraft after BMT, those transcripts differentially expressed in the HSC-enriched populations from all three tissues should include all transcripts vital to HSCs, while those genes expressed only in one tissue type, as well as those due to differences in the heterogeneous makeup of the CD34$^+$/CD38$^-$/Lin$^-$ population, would tend to be filtered out.

Intersection analysis identified 4746 transcripts expressed by the HSC-enriched populations from all three tissues (FIG. 1A). These genes encoded transcription factors, signaling/receptor proteins, and other molecules with known functions. In concordance with the observations of other stem cell studies (Terskikh et al., (2001) Proc. Natl. Acad. Sci. U.S.A., 98:7934-7939; Akashi et al., (2003) Blood, 101:383-389; Park et al., (2002) Blood, 99:488498, Ramalho-Santos et al., (2002) Science 298:597-600; Ivanova et al., (2992) Science 298:601-604; Zhou et al., (2001) Proc. Natl. Acad. Sci, 98:13966-13971), a plurality of the HSC-expressed genes had unknown function, were ESTs, or encoded hypothetical proteins.

Figure 4:
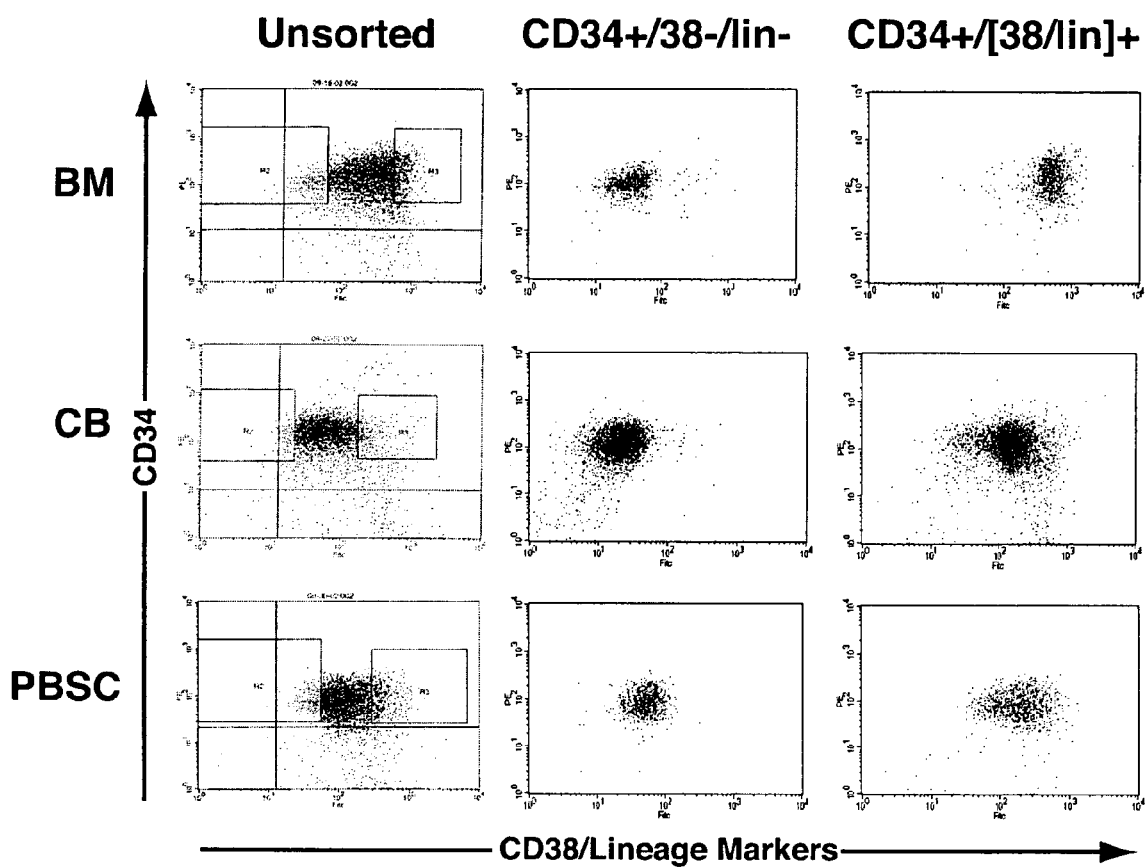
FIG. 4 shows flow cytometry plots depicting isolated the CD34+/CD38−/Lin− and CD34+/[CD38/Lin]++ cell populations from BM, CB, and PBSC. 1.8-2.8×10⁷ viable cells per sample were FACS sorted. The average RNA content (~1.5 pg/cell) of both the CD34+/CD38−/Lin− and CD34+/[CD38/Lin]++ cells dictated a requirement for ~1×10⁶ FACS-sorted cells per cell population to yield sufficient RNA for transcriptome analysis. Therefore for these experiments, the 5-10% of cells with the highest and the lowest intensity of FITC fluorescence (corresponding to expression of the CD38/Lin marker cocktail) were sorted by FACS as the CD34+/[CD38/Lin]++ and the CD34+/CD38−/Lin− cell preparations, respectively. This resulted in 8% of the cells from CB (a single FACS sort), 8.5% from BM (average of two sorts), and 9% from PBSC (average of two sorts) being isolated as the CD34+/CD38−/Lin− and CD34+/[CD38/Lin]++ cell populations. CB cells yielded 2 μg RNA for the CD34+/CD38−/Lin− and 2.3 μg for the CD34+/[CD38/Lin]++ cells; BM (average of two samples) 1.6 μg and 1.6 μg, and PBSC (average of two samples) 1.5 μg and 1.1 μg, respectively. Re-analyses of the starting CD34+ cells and the FACS-sorted cells are shown for one of the FACS sorts for each tissue. The FACS re-analyses demonstrated that the isolated cell populations were highly enriched.
Figure 5B:
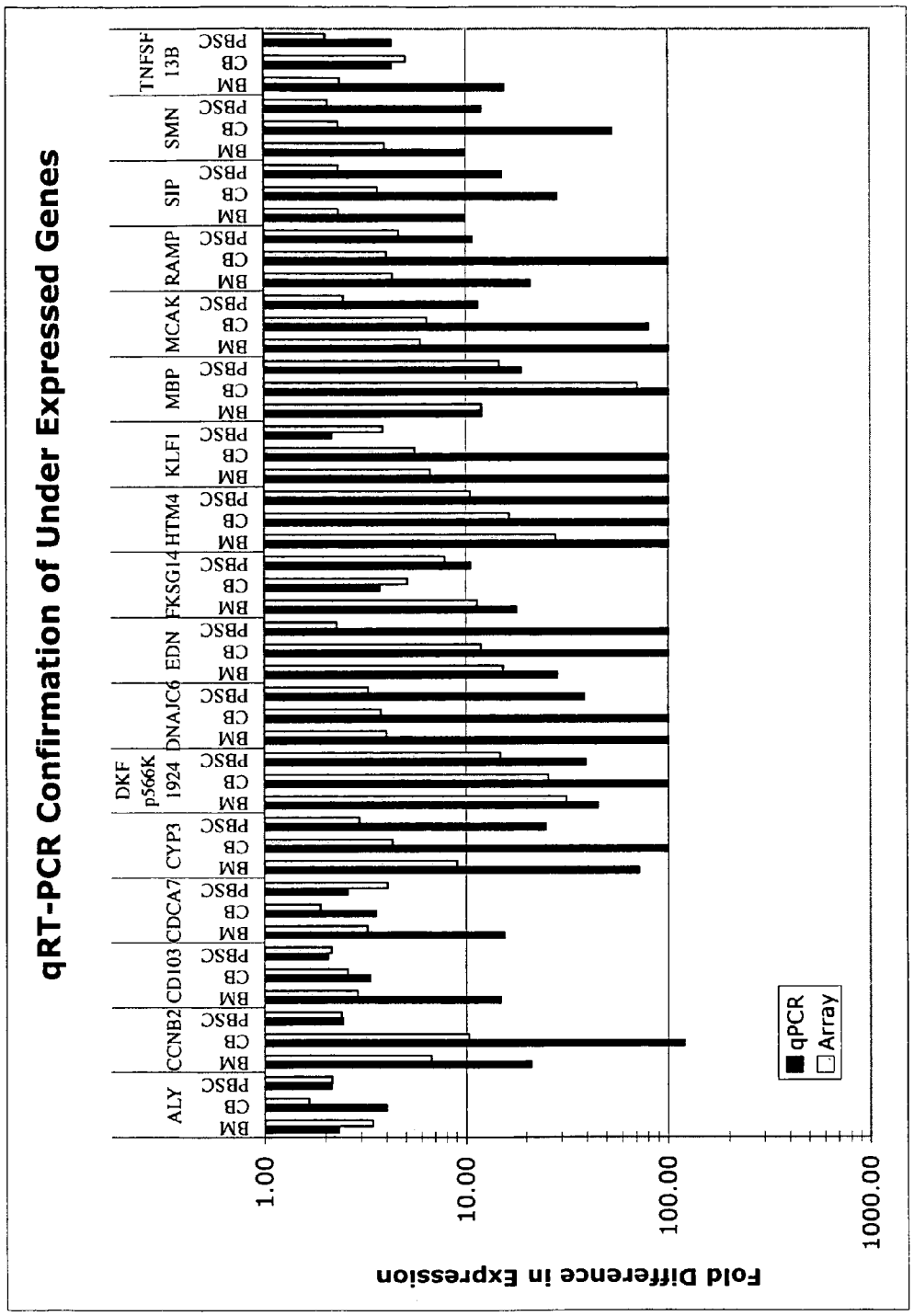

Our list of genes expressed in CD34$^+$/CD38$^-$/Lin$^-$ cells includes a number of genes previously shown to be involved in hematopoiesis (e.g., KIT, FLT3, GATA-2, GATA-3, p27, HoxA5, HoxA9), as well as markers for HSCs (e.g., CD34, MDR2). Many genes known (or expected) to be expressed only by HPCs or more mature blood or immune cells (e.g., myeloperoxidase, CD38) are not present in this HSC list, but are detected in the HPC population. These indicate stringent purity of the HSC and HPC populations which we examined, as suggested by the flow cytometric re-analysis of the purified cell populations (FIG. 4). Genes expressed by only one population, and many of those expressed by two populations, should fall within the following categories: (1) genes expressed due to tissue specific micro-environment, (2) genes expressed because of different proportions of HSCs to non-HSCs (i.e., very early progenitor) cells within the CD34$^+$/CD38$^-$/Lin$^-$ population, or (3) genes falsely scored positive by the Affymetrix chip system. Intersection Analysis is designed to exclude all of these conditions. We generated lists of genes that were differentially expressed (with a statistically significant two-fold change) in the microarray analyses of the CD34$^+$/CD38$^-$/Lin$^-$ versus the CD34$^+$/[CD38/Lin]$^{++}$ population. Approximately 2359 genes (1190 over- and 1159 under-expressed) were differentially expressed by BM, 1828 genes (889 over- and 939 under-expressed) by CB, and 1124 genes (605 over- and 519 under-expressed) by PBSC CD34$^+$/CD38$^-$/Lin$^-$ cells. In contrast to these large numbers of differentially expressed genes in any single tissue, only 81 genes were over-represented (FIG. 2A, Table 1) and 90 genes were under-represented in the "intersection" (FIG. 3A, Table 2) of HSC-enriched populations. qRT-PCR showed a 98% confirmation rate for a representative sample of the over- and under-expressed transcripts (FIG. 5). In addition, SAGE analysis of the BM HSC versus HPC populations yielded non-redundant tags for 65 of the microarray-over-expressed transcripts, and HSC-over-expression was confirmed for 61 (94%) of these genes (Table 1). These qRT-PCR and SAGE results provide extremely high confirmation rates for our microarray gene expression analyses, indicating that the Intersection Analysis was highly selective for identifying actual differentially expressed genes and for filtering out false positives.

Terskikh et al ((2001) Proc. Natl. Acad. Sci. U.S.A., 98:7934-7939) and Akashi et al ((2003) Blood, 101:383-389) showed that "hematopoietic" genes expressed by mouse HSCs diminish during differentiation to early and late HPCs, which begin to express lineage-specific genes. Our data with human HSC- and HPC-enriched populations tend to confirm this finding for the equivalent human genes, e.g., HoxA5, HoxA9, Bmi-1, RER, Tyk2, JAM1, API-1 and API-2, although a number of these genes were not differentially expressed (at >2-fold between the HSC and HPC populations) in all three tissues.

A current theory to explain the multipotent, and possible trans-differentiation potential of stem cells is that they exist in an open epigenetic state; this would allows the stem cell to develop toward any lineage by transcriptional upregulation of any lineage-specific set of genes without chromatin remodeling. Gene silencing would occur in maturing cells, resulting in a more restricted transcriptome. Akashi et al ((2003) *Blood*, 101:383-389) suggest that HSCs have an open chromatin structure, since they appear to weakly express a number of genes normally associated with non-hematopoietic cell types. Our overall expression data (FIG. 1A), support this theory, since a number of "non-hematopoietic" genes are detected, e.g., neuronal-associated genes ANA/BTG3, GIF/TIEG, and SMN1; endothelial-associated genes ANG-1 and PROCR/EPCR; liver-associated genes CYP2C38, CPT1, and aldo-keto reductase 1; and muscle-associated genes MEF2 and NRAP. Furthermore, in our results, fetal CB HSCs (hypothesized to be more a more primitive population than adult BM or PBSC HSCs) expressed many more genes than adult BM or PBSC HSCs.

The HSC population over-expressed a number of known genes which may be involved in the seminal characteristics of the stem cell. Krupple-like Factors 2 and 4 (KLF2 and KLF4), are thought to be regulators of cellular quiescence, maintenance, and cell cycle arrest. (Wani et al., (1999) *J Biol Chem.*, 274:21180-21185; Kuo et al., (1997) *Science*, 277: 1986-1990; Schober et al., (1999) *J Immunol.*, 163: 3662-3667; Glynne et al., (2000) *Immunol Rev.*, 176: 216-246; Zhang et al., (2000) *J Biol Chem.*, 275: 18391-18398; Dang et al., (2003) *Oncogene*, 22: 3424-3430; Shie et al., (2000) *Nucleic Acids Res*, 28: 2969-2976; Chen et al., (2001) *J Biol Chem.*, 276: 30423-30428; Chen et al., (2003) *J Mol Biol.*, 326: 665-677).

CEBPB has been shown to control the expression of a number of cytokines in immune cells (Rosati et al., (2001) *J Immunol.*, 167: 1654-1662), and is involved in cell survival and tumorigenesis associated with the RAS oncogene (Zhu et al., (2002) *Proc Natl Acad Sci U S A*, 99: 207-212). The Hepatic Leukemia Factor (HLF) gene (PPHN in the mouse) is a bZIP transcription factor of unknown function (Hunger et al., (1992) *Genes Dev.*, 6: 1608-1620) that is a fusion partner with the E2A gene in a subset of human B precursor acute lymphoblastic leukemia cases with chromosomal translocation t(17;19) (Honda et al., (1999) *Blood*, 93: 2780-2790 and Smith et al., (1999) *Mol Cell Biol.*, 19: 4443-4451).

Two recently annotated genes may also play roles in self-renewal by limiting the effects of growth factor directed differentiation. HOP (homeodomain only protein) is a putative negative-regulator of genes normally expressed due to serum response factor (SRF)(Chen et al., (2002) *Cell*, 110: 713-723). hIAN2 (human immune-associated nucleotide 2 protein) is a putative control protein of GDP/GTP signaling proteins (Cambot et al., (2002) *Blood*, 99: 3293-3301). GATA-3 is a zinc-finger transcription factor (Ho et al., (1999 l) *EMBO J*, 10: 1187-1192) that is expressed in a number of embryonic tissues (Ko et al., (1991) *Mol Cell Biol.*, 11: 2778-2784 and George et al., (1994) *Development*, 120: 2673-2686). One function in later cells is regulating development of T cells.(Marine et al., (1991) *Proc Natl Acad Sci USA.*, 88: 7284-7288 and Glimcher et al., (2000) *Genes Dev.*, 14: 1693-1711)

We found two HOX genes (Balavoine et al., (2002) *Mol Phylogenet Evol.*, 24: 366-373 and Prince (2002) *Dev Biol.*, 249: 1-15, 2002) over-expressed. HoxA3 is involved in formation of the nervous system (Chisaka et al., (1991) *Nature*, 350: 473-479 and Watari et al., (2001) *Dev Biol.*, 240: 15-31), pharyngeal glandular organs (Manley et al., (1998) *Dev Biol.*, 195: 1-15), and thymic epithelial cells (Su et al., (2000) *J Immunol.*, 164: 5753-5760), but has not been studied in hematopoiesis. HoxB6 is expressed in HSPCs (Shen et al., (1992) *EMBO J.*, 11: 983-989; Magli et al., (1997) *J Cell Physiol.*, 173: 168-177 and Sauvageau et al., (1994) *Proc Natl Acad Sci U S A.*, 91: 12223-12227), is involved in differentiation of the granulocytic lineage (Giampaolo et al., (2002) *Leukemia*, 16: 1293-1301), and may suppress development of erythroid progenitors (Kappen (2000) *Am J Hematol.*, 65: 111-118). Also, Hematopoietic Pbx-interacting protein (HPIP) has been shown to interact with, and presumably regulates function of, all PBX family members. (Abramovich et al., (2000) *J Biol Chem.*, 275: 26172-26177 and Hunger et al., (1996) *Blood*, 87: 1211-1224.). Myelodysplastic Syndrome Gene 1 (MDS1) is fused to the AML1 gene in some cases of treatment-related myelodysplastic syndrome. This fusion gene decreases contact inhibition of cells, and increases tumorigenicity and the ability of cells to grow in suspension culture. (Zent et al., (1996) *Proc Natl Acad Sci USA.*, 93: 1044-1048). Evidence is rapidly accumulating to support the role of histones in gene expression and gene silencing, as well as, in control of cell fate (Chen et al., (2000) *Proc Natl Acad Sci U S A.*, 97: 377-382; Hampsey (1997) *Trends Genet.*, 13: 427-429 and Turner (1991) *J Cell Sci.*, 99(Pt1):13-20). NRIP1/RIP140 is a co-regulator of a number of hormone receptors, (Wu et al., (1996) *Mol. Cell Biol.*, 16: 4128-4136 and Xue et al., (1996) *Mol. Cell Biol.*, 16: 1567-1575), functioning as a negative regulator of nuclear receptors through recruitment of histone deacetylases (Treuter et al., (1998) *Mol. Endocrinol.*, 12:864-881). Possibly, histone deacetylase recruitment by RIP140 might regulate gene expression within HSCs. RBPMS/HERMES, an RNA-processing protein, may play a role in the epigenetic state by editing RNA to express various splice variants, or by interacting with the siRNA mechanism to influence gene expression.

In addition to confirming the microarray results, our analysis to date of the SAGE results revealed three additional interesting findings. First, SAGE detected 10,078 transcripts expressed in the HSC-enriched population compared to 6366 detected by microarray analysis. Thus, as many as ~30% of the genes expressed by the HSC-enriched population were not detected by microarray, most likely due to low copy number or high probe set background (the latter would cause the MAS 5.0 software to make an "Absent" call for that particular transcript). We scored a transcript tag as "Present" only if it occurred at a frequency of two tags or greater. Although unlikely, it is possible that a small number of transcripts are false positives due to sequencing errors during tag detection. In addition, it is possible that a small percentage of the detected tags identify splice variants of the same gene. 2008 of the transcripts identified by SAGE were expressed exclusively within the HSC population (not detected in HPCs), many times more transcripts than were exclusively expressed within the HPC-enriched population. This finding further strengthens the observations of Terskikh et al (7) and Akashi et al (9) that the number of genes expressed by HSCs decreases as the cells differentiate and that HSCs maintain an open chromatin structure. This considerable number of additional transcripts beyond those identified by the microarrays may be involved in HSC biology.

We found 646 tags expressed by the HSC-enriched population which did not correspond to any known gene or EST. This suggests that cells within the HSC population express a large number of completely novel transcripts, ~6% of all the transcripts which they expressed. One caveat to these numbers is that some of the unidentified tags may identify the same transcript, although the number of transcripts with multiple tags would be expected to comprise only a small percentage of the tags detected.

Genes found to be differentially over-expressed by independent laboratories should be the highest priority candidate genes to further "audition for" key roles in HSC biology. To illustrate, we performed a limited meta-analysis of microarray results (Rhodes et al., (2002) *Cancer Res.,* 62:4427-4433 and Khan et al., (1999) *Biochim. Biophys. Acta,* 1423:M17-28). We compared the list of 81 genes over-represented in our human CD34+/CD38−/Lin− cells to the reported findings for HSC-enriched populations in two recent studies which examined the transcriptomes of several types of stem cells, including mouse BM Kit+Lin−Sca-1+ SP HSPCs and human CD34+/CD38−/Lin− HSPCs, mouse Kit+Lin−Sca-1+ AA4.1+ fetal-liver HSPC, and mouse Kit+Lin−Sca-1+ Rhodaminelo BM HSPC (Ivanova et al., (2002) *Science,* 298: 601-604 and Ramalho-Santos et al., (2002) *Science,* 298:597-600). Only the transcription factor GATA3 was over-represented in all four datasets. Three transcription factors (HLF, MDS1, and CEBPB), one RNA-processing protein (RBPMS/HERMES), and one cell surface receptor (MPL/CD110) were found in our own results plus two of the other data sets (Table 3). Two major problems limited the power of this comparison: First, at the time of this analysis 35 of the 81 genes which were over-represented in our study do not have a homologous mouse Unigene cluster; this made meta-comparison of these 35 genes to the mouse data impossible. Second, the Ivanova et al ((2002) *Science,* 298:601-604) human HSC dataset presented expression results for only 822 human-mouse homologous gene pairs.

Recently, it has been proposed that cancer is a stem cell disease (Larochelle et al., (1996) *Nat. Med.,* 2:1329-1337; Lapidot et al., (1994) *Nature,* 367:645-648; Lapidot et al., (1996) *Blood,* 88:2655-2664 83; Reya et al., (2001) *Nature,* 414:105-111; Hemmati et al., (2003) *Proc Natl Acad Sci USA.,* 100:15178-15183; Al-Hajj et al., (2003) *Proc Natl Acad Sci USA.,* 100:3983-3988 and Bonnet (2001) *Rev. Clin. Exp. Hematol.,* 5:42-61). Most cancers may arise from self-renewing stem cells. Alternatively, cancer cells may mutationally gain certain characteristics of stem cells, particularly the abilities to self-renew and give rise to large numbers of differentiated progeny. A number of the genes identified in this study have already been implicated in hematologic malignancies; CD110/MPL is a good example. Over-expression of CD110 has been demonstrated to immortalize HSPCs. Presumably, some of the other over-expressed genes, including the known and the newly identified genes maybe be involved in carcinogenesis, especially leukemogenesis. A number of studies have shown that at least some cancers are stem cell diseases. Hemmati et al (REF) found a sub-population of brain tumor cells that both resemble neural stem cells, and that exclusively are able to give rise to further tumors. Al-Hajj et al ((2003) *Proc Natl Acad Sci U S A.,* 100:3983-3988) describe similar findings in breast tumors, in that a protein-expression defined sub-set of tumor "stem" cells were the only cells able to reconstitute the tumor. Finally a number of studies have shown that leukemias arise from cells with HSC characteristics (Larochelle et al., (1996) *Nat. Med.,* 2:1329-1337; Lapidot et al., (1994) *Nature,* 367: 645-648; Lapidot et al., (1996) *Blood,* 88:2655-2664 83 and Bonnet (2001) *Rev. Clin. Exp. Hematol.,* 5:42-61). Thus, identification of the full spectrum of genes involved in the biology of the HSC is critically important for the study of leukemia and likely other cancers. Our rigorous examination of the transcriptomes of HSCs from all three of the major hematopoietic tissue sources should lead to identification of novel target genes involved in the development of hematopoietic and other malignancies.

TABLE 1

Genes over-represented in the CD34+/CD38−/Lin− population from all three tissues (BM, CB, PBSC)

| Common Name(s)[1] | Fold Change | | | | UniGene[3] | Known/(probable) Function |
|---|---|---|---|---|---|---|
| | BM SAGE[2] | BM | CB | PBSC | | |
| AD036 mRNA | ND | 3.49 | 2.29 | 4.19 | (AF260333.1) | Unknown |
| ARG2 | 3.0 | 3.73 | 2.46 | 2.01 | Hs.172851 | Nitric oxide and polyamine metabolism |
| BIRC3 | 2.0 | 2.39 | 3.45 | 2.17 | Hs.127799 | Inibitor of Apoptosis |
| BST2 | 2.3 | 8.88 | 3.92 | 3.36 | Hs.118110 | (growth and development of B-cell) |
| CD37 | 2.3 | 5.10 | 2.64 | 2.42 | Hs.153053 | (signal transduction, T-cell-B-cell interactions) |
| CD52* | 1.0 | 25.10 | 4.28 | 2.88 | Hs.276770 | Unknown |
| cDNA DKFZp434C1915* | ND | 10.56 | 3.32 | 4.85 | Hs.46531 | Unknown |
| cDNA DKFZp434G012* | ND | 13.65 | 2.33 | 3.38 | Hs.303154 | Unknown |
| cDNA DKFZp564E227* | ND | 4.29 | 2.06 | 2.83 | (AL136693.1) | Unknown |
| cDNA DKFZp564F053* | 3.5 | 4.29 | 2.01 | 2.05 | Hs.71968 | Unknown |
| cDNA DKFZp586J0323* | HSC | 7.14 | 4.83 | 2.73 | Hs.102301 | Unknown |
| cDNA FLJ14054* | 3.0 | 3.30 | 4.78 | 2.31 | Hs.13528 | Unknown |
| cDNA FLJ20378* | HSC | 3.55 | 1.76 | 2.03 | Hs.136252 | Unknown |
| cDNA FLJ21472, KIAA1939* | ND | 4.41 | 2.31 | 2.17 | Hs.182738 | Unknown |
| cDNA FLJ22690* | HSC | 11.68 | 2.09 | 2.71 | Hs.105468 | Unknown |
| cDNA FLJ40058* | ND | 2.84 | 1.70 | 2.72 | Hs.376041 | Unknown |
| CEBPB | HSC | 2.25 | 2.05 | 2.38 | Hs.99029 | transcription factor with bZIP-domain |
| CIS2, SOCS-2* | 2.4 | 7.55 | 3.14 | 2.35 | Hs.351744 | (regulation of insulin-like growth factor-1 receptor (IGF1R) mediated cell signaling) |
| CLECSF2* | 2.3 | 2.53 | 2.16 | 2.07 | Hs.85201 | Unknown |
| COX6B | 4.5 | 8.28 | 2.37 | 2.63 | Hs.174031 | Subunit VIb of cytochrome c oxidase |
| CRFBP, CRF-BP* | 12.0 | 34.62 | 9.85 | 3.96 | Hs.115617 | binds to CRH in plasma and inhibits stimulation of pituitary adrenocorticotropic hormone release |

TABLE 1-continued

Genes over-represented in the CD34+/CD38−/Lin− population from all three tissues (BM, CB, PBSC)

| Common Name(s)[1] | BM SAGE[2] | Fold Change BM | CB | PBSC | UniGene[3] | Known/(probable) Function |
|---|---|---|---|---|---|---|
| cDNA DKFZP434J214* | 2.7 | 4.16 | 2.10 | 2.11 | Hs.12813 | Unknown, (role in telomere maintenance) |
| ECM | ND | 5.77 | 2.10 | 3.54 | Hs.268107 | actor V/Va-binding protein, (carrier protein for platelet factor V), (extracellular matrix or adhesive protein), |
| EST* | 2.0 | 2.20 | 2.39 | 2.43 | Hs.156044 | Unknown |
| EST* | HSC | 2.34 | 1.75 | 2.16 | Hs.272148 | Unknown, similar to PRO0478 protein |
| FOSB, GOS3, GOSB | HSC | 2.53 | 3.53 | 2.38 | Hs.75678 | dimerizes with proteins of the JUN family, regulators of cell proliferation, differentiation, and transformation |
| GATA3, HDR, MGC5445 | ND | 4.84 | 4.07 | 4.23 | Hs.169946 | Member of a GATA family of Zinc-finger transcription factors; involved in T-cell antigen regulation |
| GBP2 | 2.2 | 4.55 | 2.31 | 2.04 | Hs.171862 | GTPase that converts GTP to GDP and GMP |
| GERP, TRIM8* | 3.0 | 3.15 | 2.06 | 2.83 | Hs.54580 | (Tumor Suppressor) |
| GUCY1A3 | ND | 4.29 | 2.72 | 2.06 | Hs.75295 | subunit of soluble guanylate cyclase; heterodimer with the beta 1 subunit of GUCY1A3 functions as the receptor for nitric oxide and nitrovasodilator, converts GTP to cGMP |
| GUCY1B3 | HSC | 2.06 | 2.00 | 2.15 | Hs.77890 | subunit of soluble guanylate cyclase; heterodimer with the alpha 1 subunit of GUCY1A3 functions as the receptor for nitric oxide and nitrovasodilator, converts GTP to cGMP |
| H1F0, H10, H1FV, MGC5241 | 2.2 | 4.72 | 4.05 | 2.34 | Hs.226117 | H1(0)-type member of the H1 histone family; helps compact DNA into nucleosomes and high-order chromatin structures |
| H1F2, H1.2, HIST1H1C, MGC: 3992 | ND | 2.72 | 5.42 | 3.23 | Hs.7644 | Member 2 of the H1 histone family of proteins; helps compact DNA into nucleosomes and high-order chromatin structures |
| H2A histone family, member L | ND | 4.53 | 4.17 | 3.43 | (AL353759) | Unknown |
| H2AFA, H2A.1, H2A.2, H2A/a, HIST1H2AE | ND | 2.42 | 5.06 | 4.03 | Hs.121017 | Member A of the H2A histone family; involved in compaction of DNA into nucleosomes |
| H2AFO, H2A, H2A.2, H2A/O, H2a-615 | ND | 2.26 | 5.90 | 3.20 | Hs.795 | Member O of the H2A histone family; involved in compaction of DNA into nucleosomes |
| H2AFO, H2A, H2A.2, H2A/O, H2a-615 | ND | 2.02 | 5.66 | 2.87 | Hs.795 | Member O of the H2A histone family; involved in compaction of DNA into nucleosomes |
| H2B histone family, member B | ND | 3.72 | 3.89 | 5.06 | (AL353759) | Unknown |
| H2BFA, H2B/a, H2B.1A, HIST1H2BG | 2.0 | 3.35 | 2.90 | 3.54 | Hs.352109 | Member A of the H2B histone family; involved in compaction of DNA into nucleosomes |
| H2BFB, H2B/b, H2B.1B, HIRIP2, HIST1H2BD, dJ221C16.6 | 2.0 | 2.72 | 4.56 | 3.66 | Hs.180779 | Member B of the H2B histone family; involved in compaction of DNA into nucleosomes |
| H2BFG, H2B/g, HIST1H2BF | 2.0 | 2.18 | 4.06 | 5.35 | Hs.182137 | Member G of the H2B histone family; involved in compaction of DNA into nucleosome |
| H2BFL, H2B.1, H2B/1, HIST1H2BC, dJ221C16.3 | 2.0 | 2.61 | 7.21 | 3.70 | Hs.356901 | Member L of the H2B histone family; involved in compaction of DNA into nucleosomes |
| H2BFQ, H2B, GL105, H2B.1, H2B/q | 2.0 | 3.01 | 6.65 | 2.81 | Hs.2178 | Member of the H2B histone family; may be involved in compaction of DNA into nucleosomes |
| H2BFT, H2B/S, H2BFAiii | 2.0 | 2.53 | 3.14 | 3.70 | Hs.247817 | This gene encodes a member of the histone H2B family, (unknown) |
| H3FB, H3/b, HIST1H3D | 2.0 | 2.04 | 2.26 | 5.98 | Hs.143042 | Member B of the H3 histone family; involved in compaction of DNA into nucleosomes |
| H3GK, H3/k, H3F1K | 2.7 | 2.01 | 3.26 | 3.35 | Hs.70937 | Member K of the H3 histone family; involved in compaction of DNA into nucleosomes |
| HLA-DQA1, DQA1, HLA-DQ, HLA-DQA | 0.2 | 9.36 | 2.02 | 2.02 | Hs.198253 | Alpha 1 chain of HLA-DQ1 class II molecule (Ia antigen); complex binds peptides and presents them to CD4+ T lymphocytes |
| HLA-DQB1, IDDM1, HLA-DQB | 1.0 | 2.92 | 3.58 | 2.89 | Hs.73931 | Highly similar to A class II molecule beta chain (Ia antigen) (murine H2-Ab1); may bind and present peptides to CD4+ T lymphocytes; contains an immunoglobulin (Ig) domain |
| HLA-E | 4.8 | 9.17 | 3.19 | 2.05 | Hs.381008 | Nonclassical MHC I molecule; associates with beta 2-microglobulin |
| HLF* | 32.0 | 60.89 | 12.90 | 10.19 | Hs.250692 | (similar ro transcription factors involved in developmental stage-specific gene expression) |
| HOXA3* | ND | 6.72 | 5.03 | 3.08 | Hs.248074 | transcription factor, spatially and temporally regulated during embryonic development |
| HOXB6 | ND | 11.04 | 1.81 | 5.37 | Hs.183096 | Transcription factor |
| HPIP | 3.6 | 5.89 | 2.73 | 2.35 | Hs.8068 | inhibits the binding of PBX1-HOX complexes to DNA |
| HSP25 | 4.0 | 3.06 | 7.21 | 4.98 | Hs.76067 | (may function in thermotolerance and drug resistance) |

TABLE 1-continued

Genes over-represented in the CD34+/CD38−/Lin− population from all three tissues (BM, CB, PBSC)

| Common Name(s)[1] | BM SAGE[2] | Fold Change BM | CB | PBSC | UniGene[3] | Known/(probable) Function |
|---|---|---|---|---|---|---|
| HSPC053* | 4.5 | 8.50 | 3.73 | 2.93 | Hs.128155 | Unknown |
| HUSI-II, SPINK2 | 7.3 | 13.29 | 3.07 | 3.22 | Hs.98243 | protease inhibitor |
| IDI1 | HSC | 2.02 | 1.22 | 2.95 | Hs.76038 | Cholesterol metabolism, interconverts isopentenyl diphosphate and dimethylallyl diphosphate during isoprenoid synthesis |
| IEGF, PDGFD, MSTP036 | 2.8 | 2.69 | 2.21 | 2.64 | Hs.112885 | Mitogenic factor for cells of mesenchymal origin, member of the platelet-derived growth factor family |
| INPP4B | 2.4 | 4.19 | 2.44 | 2.67 | Hs.153687 | phosphatidylinositol signaling, removes the phosphate group at position 4 of the inositol ring from inositol 3,4-bisphosphate |
| KIAA0125* | ND | 5.50 | 2.39 | 2.23 | Hs.38365 | Unknown |
| KIAA1102 | 5.0 | 20.30 | 6.79 | 3.92 | Hs.202949 | Unknown |
| KLF2* | HSC | 3.31 | 3.18 | 5.31 | Hs.107740 | Transcription factor |
| KLF4* | 2.5 | 4.93 | 2.42 | 2.48 | Hs.356370 | Transcription Factor, regulates genes involved in epidermal barrier function |
| LAGY, HOP* | 2.5 | 12.95 | 3.59 | 2.83 | Hs.13775 | Unknown |
| MDS1 | ND | 3.64 | 4.86 | 2.95 | Hs.54504 | Unknown, (Similar to the PR domain of the zinc-finger protein RIZ) |
| MLLT3* | ND | 6.10 | 4.03 | 2.45 | Hs.404 | Unknown |
| MPLV, CD110* | HSC | 20.48 | 2.28 | 2.64 | Hs.84171 | Member of the Hematopoietic receptor superfamily, capable of immortalizing bone marrow hematopoietic cells from different lineages |
| NPR3 | ND | 3.97 | 2.43 | 2.07 | Hs.123655 | involved in clearance of natriuretic peptides, and required for timing of endochondral ossification |
| NRIP1 | HSC | 5.55 | 5.04 | 3.75 | Hs.155017 | modulates transcriptional activity of the estrogen receptor, interacts with the hormone-dependent activation domain AF2 of nuclear receptors |
| PLS3 | 3.3 | 4.18 | 2.35 | 2.43 | Hs.4114 | actin-binding protein, L isoform is expressed only in hemopoietic cell lineages, while the T isoform has been found in all other normal cells of solid tissues that have replicative potential (fibroblasts, endothelial cells, epithelial cells, melanocytes, etc.) |
| PPM1F, FEM-2, POPX2, KIAA0015 | 3.0 | 6.08 | 2.86 | 3.09 | Hs.278441 | negative regulator of p21-activated kinase PAK, Ca2+/calmodulin-dependent protein kinase phosphatases promoting apoptosis |
| PRKCH | 2.5 | 8.41 | 2.72 | 2.15 | Hs.315366 | binds phorbol esters |
| RA-GEF, KIAA0313, DKFZP586O1422 | 3.0 | 4.04 | 2.94 | 2.87 | Hs.154545 | Unknown |
| RBPMS, HERMES* | HSC | 52.96 | 3.92 | 5.25 | Hs.80248 | (RNA metabolism) |
| ROBO4* | 2.0 | 11.91 | 7.92 | 5.22 | Hs.111518 | Unknown, low similarity to ROBO1 |
| RPS21 | 2.0 | 3.18 | 1.48 | 2.10 | Hs.356317 | component of the small 40S ribosomal subuni |
| SPTBN1 | 7.3 | 5.92 | 3.26 | 2.51 | Hs.107164 | member of a family of actin-cross linking proteins, (may crosslink actin proteins of the membrane-associated cytoskeleton) |
| TFPI | HSC | 4.11 | 2.44 | 2.34 | Hs.170279 | a Kunitz-type protease inhibitor that inhibits fibrin clot formation |
| TRAIL | 2.0 | 3.32 | 2.27 | 3.41 | Hs.83429 | cytokine, shown to trigger the activation of MAPK8/JNK, caspase 8, and caspase 3 |
| TLOC1 | 2.0 | 3.89 | 2.38 | 2.52 | Hs.8146 | protein translocation apparatus of the endoplasmic reticulum (ER) membrane |
| Unnamed* | ND | 3.43 | 1.56 | 2.47 | Hs.130694 | Unknown |
| WWP1 | 2.0 | 3.32 | 2.26 | 2.06 | Hs.355977 | Unknown |

[1] Genes marked with an * were confirmed by qRT-PCR

[2] HSC denotes that SAGE tags were only detected in the HSC population and not in the HPC population. ND indicates that unique, reliable SAGE tags were not available for this transcript

[3] Unigene cluster numbers are given when available. Those numbers in parenthesis indicate the Genebank assession number for those genes that have not been assigned Unigene Cluster numbers.

TABLE 2

Genes under-represented in the CD34+/CD38−/Lin− population from all three tissues (BM, CB, PBSC).

| Common Name(s)[1] | Fold Decrease[3] | | | UniGene[2] (GeneBank) | Known/(Predicted) Function |
|---|---|---|---|---|---|
| | BM | CB | PBSC | | |
| ADE2H1 | 3.97 | 2.70 | 3.05 | Hs.117950 | purine biosynthesis |
| ADRP | 7.04 | 5.97 | 4.78 | Hs.3416 | Increase in mRNA levels is one of the earliest indications of adipocyte differentiation |
| AKAP2, AKAPKL, AKAPKL, KIAA0920, DKFZp564L0716 | 2.37 | 2.47 | 10.13 | Hs.42322 | A kinase anchor protein; (may function in signaling systems polarity) |
| ALY* | 3.41 | 1.65 | 2.15 | (AF047002.1) | transcription factor |
| APOC1 | 7.78 | 5.05 | 4.66 | Hs.268571 | activated when monocytes differentiate into macrophages |
| BM28, CCNL1, CDCL1, D3S3194, KIAA0030 | 5.25 | 3.22 | 5.54 | Hs.57101 | regulates entry into S phase |
| C1QBP | 3.39 | 3.07 | 2.23 | Hs.78614 | inhibits complement-mediated lysis |
| CCNB2* | 6.69 | 10.26 | 2.38 | Hs.194698 | may play a key role in transforming growth factor beta-mediated cell cycle contro |
| CD103, HUMINAE* | 2.78 | 2.55 | 2.14 | Hs.851 | preferentially expressed on human intestinal intraepithelial lymphocytes (IEL, may serve as an accessory molecule for IEL activation |
| CDCA7* | 3.22 | 1.89 | 4.04 | (AY029179.1) | identified as a c-Myc responsive gene, and behaves as a direct c-Myc target gene, suggesting its involvement in c-Myc-mediated cell transformation |
| cDNA DKFZP434L0718 | 2.74 | 2.22 | 2.48 | Hs.59236 | Unknown |
| cDNA DKFZp586C0224 | 2.49 | 3.23 | 2.79 | (AL117653.1) | Unknown |
| cDNA DKFZp686L1553 | 10.92 | 4.17 | 2.24 | Hs.35962 | Unknown |
| cDNA FLJ20249 | 2.93 | 1.50 | 3.36 | Hs.389657 | Unknown |
| cDNA FLJ20378 ESTs* | 2.49 | 1.65 | 2.21 | Hs.34549 | Unknown |
| cDNA FLJ20378* | 3.15 | 2.55 | 2.39 | Hs.343588 | Unknown |
| cDNA FLJ20489 EST | 8.90 | 3.75 | 2.75 | Hs.165909 | Unknown |
| cDNA FLJ20958 ESTs | 3.74 | 14.24 | 6.19 | Hs.21766 | Unknown |
| cDNA FLJ21120 | 4.79 | 35.46 | 7.43 | Hs.133546 | Unknown |
| cDNA FLJ21763 | 2.09 | 1.88 | 2.35 | (AK025416.1) | Unknown |
| cDNA FLJ22940 | 4.26 | 2.12 | 2.35 | Hs.15277 | Unknown |
| cDNA FLJ23376 | 3.03 | 2.41 | 2.11 | (AK027029.1) | Unknown |
| cDNA FLJ23386 | 4.85 | 3.32 | 2.96 | (AK027039.1) | Unknown |
| CHK1 | 4.89 | 4.21 | 2.67 | Hs.20295 | Protein kinase; inhibits mitotic entry after DNA damage, required for the DNA damage checkpoint |
| CPA3 | 3.62 | 5.52 | 4.10 | Hs.646 | Mast cell carboxypeptidase A is a secretory granule metalloexopeptidase |
| CSF2RB | 3.51 | 2.94 | 10.69 | Hs.285401 | CSF2RB is a common beta chain of the high affinity receptor for IL-3, IL-5 and CSF |
| CYP3* | 9.04 | 4.29 | 2.93 | Hs.173125 | catalyze the cis to trans isomerization of certain proline imidic peptide bonds in oligopeptides |
| dJ616B8.3 | 8.09 | 2.09 | 3.28 | (BC001068.1) | Unknown |
| DKC, NAP57, NOLA4, XAP101, dyskerin | 2.35 | 2.35 | 2.54 | Hs.4747 | binds telomerase RNA, may have cell cycle and nucleolar functions |
| DLC1 | 8.09 | 4.93 | 13.05 | Hs.8770 | (DLC1 is a candidate tumor suppressor gene for human liver cancer, as well as for prostate, lung, colorectal, and breast cancers) |
| DNAJC6* | 4.02 | 3.77 | 3.26 | Hs.44896 | Molecular Chaperonin |
| DNAJC9 | 4.36 | 2.64 | 2.78 | Hs.44131 | Molecular Chaperonin |
| EDN, RNS2* | 15.36 | 11.97 | 2.27 | Hs.728 | Eosinophil-derived neurotoxin; has neurotoxic and ribonuclease activities; member of ribonuclease superfamily |
| EKLF* | 6.64 | 5.56 | 3.85 | Hs.37860 | transcriptional activator of the adult beta-globin promoter |
| ERH | 2.55 | 2.19 | 2.13 | Hs.118757 | related to the conserved Drosophila gene DROER, a trans-acting regulator that acts as an enhancer of the rudimentary gene. The rudimentary gene itself is an important enzyme in the pyrimidine pathway |
| EST | 4.69 | 1.71 | 2.24 | Hs.393212 | Unknown |
| EST | 3.44 | 1.93 | 2.44 | Hs.396419 | Unknown |
| EST | 2.13 | 1.77 | 2.38 | Hs.356481 | Unknown |
| FABP5 | 4.85 | 2.83 | 2.99 | Hs.153179 | binds stearic acid, (may have a role keratinocyte differentiation) |
| FACTP140 | 2.86 | 2.42 | 2.03 | Hs.14963 | Subunit of chromatin-specific transcription elongation factor; interacts specifically with histone H2A/H2B |
| FKSG14* | 11.36 | 5.10 | 7.86 | Hs.192843 | SoxLZ/Sox6 leucine zipper binding protein |
| FLR | 6.26 | 4.59 | 2.09 | Hs.76289 | The final step in heme metabolism in mammals is catalyzed by the cytosolic enzyme biliverdin reductase |
| GS3955* | 19.68 | 21.88 | 21.34 | Hs.155418 | Unknown |

TABLE 2-continued

Genes under-represented in the CD34+/CD38−/Lin− population from all three tissues (BM, CB, PBSC).

| Common Name(s)[1] | Fold Decrease[3] | | | UniGene[2] (GeneBank) | Known/(Predicted) Function |
|---|---|---|---|---|---|
| | BM | CB | PBSC | | |
| H2AZ | 4.99 | 4.24 | 2.18 | Hs.119192 | Member Z of the H2A histone family; involved in compaction of DNA into nucleosomes |
| HAKAI | 2.38 | 3.23 | 4.55 | Hs.292767 | HAKAI is an E3 ubiquitin ligase (see UBE3A; MIM 601623) that mediates ubiquitination of the CDH1 complex |
| HBB | 22.82 | 54.88 | 10.18 | Hs.155376 | The alpha (HBA) and beta (HBB) loci determine the structure of the 2 types of polypeptide chains in adult hemoglobin, Hb A |
| HBD | 14.26 | 6.91 | 6.32 | Hs.36977 | Two alpha chains (HBA) plus two delta chains constitute HbA-2 |
| HERG, LQT2 | 3.59 | 5.94 | 4.37 | Hs.188021 | Voltage-gated (delayed rectifier) potassium channel; forms the Ikr channels that are important for cardiac rhythm |
| HMS, PLS, CPPI, DPP1, PALS | 2.29 | 2.03 | 2.08 | Hs.10029 | lysosomal cysteine (thiol) protease |
| HT011 | 3.12 | 2.64 | 2.57 | Hs.267923 | Unknown |
| HTM4, CD20L* | 28.04 | 16.46 | 10.49 | Hs.99960 | UnknownLow similarity to CD20 and to the beta subunit of FCER1B; (may play a role in signal transduction) |
| HZwint-1 | 6.88 | 5.13 | 2.81 | Hs.42650 | clearly involved in kinetochore function although an exact role is not known, Phosphorylated during mitosis |
| KIAA0101 | 6.56 | 9.93 | 4.61 | Hs.81892 | unknown |
| KIAA0750 gene product | 3.75 | 3.89 | 3.06 | Hs.314434 | Unknown |
| LOC115106 | 2.24 | 1.87 | 2.22 | Hs.184164 | Unknown |
| LOC51053 | 6.09 | 4.02 | 2.05 | Hs.234896 | inhibits DNA replication during cell cycle S, G2, and M phases |
| MBP, BMPG* | 12.01 | 70.88 | 14.75 | Hs.99962 | plays a role in inflammation; similar to lectins and the homing receptor of lymphocytes |
| MCAK* | 5.93 | 6.41 | 2.44 | Hs.69360 | anaphase chromosome segregation and may be required to coordinate the onset of sister centromere separation |
| MCM2, CDC47 | 3.41 | 2.57 | 2.78 | Hs.77152 | chromatin-binding protein, has a probable role in DNA replication, thought to be 'DNA licensing factors' which bind to the DNA after mitosis and enable DNA replication before being removed during S phase |
| MCM6 | 4.20 | 3.90 | 3.94 | Hs.155462 | thought to be 'DNA licensing factors' which bind to the DNA after mitosis and enable DNA replication before being removed during S phase |
| MF1, RAD2, FEN-1 | 5.07 | 4.92 | 5.04 | Hs.4756 | double-stranded DNA 5'-3' exonuclease |
| MGC5350 | 2.91 | 3.09 | 2.05 | Hs.71331 | Unknown |
| MPO | 20.56 | 50.77 | 63.17 | Hs.409228 | |
| MRPL14 | 3.29 | 1.92 | 4.28 | Hs.343579 | Mammalian mitochondrial ribosomal proteins are encoded by nuclear genes and catalyze protein synthesis within the mitochondrion |
| MRPL27 | 4.73 | 1.69 | 2.47 | Hs.7736 | encoded by nuclear genes and catalyze protein synthesis within the mitochondrion |
| MRPS23 | 4.00 | 4.08 | 2.94 | Hs.5836 | encoded by nuclear genes and catalyze protein synthesis within the mitochondrion, encodes a 28S subunit protein |
| MTHFC, MTHFD | 2.85 | 2.07 | 2.05 | Hs.172665 | involved in methionine, thymidylate, and de novo purine syntheses |
| not named | 5.65 | 2.47 | 2.86 | (AL109939) | Unknown |
| not named | 5.33 | 2.84 | 7.65 | (AF308301.1) | Unknown |
| ODC1 | 2.12 | 2.85 | 2.45 | Hs.75212 | catalyzes the decarboxylation of ornithine into putrescine |
| P14L | 2.93 | 2.08 | 2.66 | Hs.178576 | Unknown |
| P4HB | 3.39 | 3.95 | 2.59 | Hs.75655 | catalyzes formation of 4-hydroxyproline in collagens |
| P5 | 2.10 | 2.13 | 2.08 | Hs.182429 | protein disulfide isomerase |
| PCCB | 4.35 | 2.53 | 2.03 | Hs.63788 | degrades branched-chain amino acids |
| PCNA | 5.04 | 4.74 | 4.58 | Hs.78996 | processivity factor for DNA polymerases delta and epsilon |
| PLACE1005453 | 2.88 | 2.55 | 2.41 | (AU156956) | Unknown |
| RAMP* | 4.32 | 4.02 | 4.64 | Hs.126774 | Unknown, regulated during the retinoic acid-induced neuronal differentiation. |
| SIP* | 2.32 | 3.64 | 2.26 | Hs.27258 | binding protein for the calcium binding protein, calcyclin; however, the consequence of this protein binding has not yet been determined |
| SLC11A3 | 4.25 | 2.62 | 2.62 | Hs.5944 | Ferroportin 1; transports iron across placental syncytiotrophoblasts to the embryo |

TABLE 2-continued

Genes under-represented in the CD34+/CD38−/Lin− population from all three tissues (BM, CB, PBSC).

| Common Name(s)[1] | Fold Decrease[3] | | | UniGene[2] (GeneBank) | Known/(Predicted) Function |
|---|---|---|---|---|---|
| | BM | CB | PBSC | | |
| SMN, OP18, PP17, PP19, PR22, LAP18* | 3.95 | 2.31 | 2.05 | Hs.250811 | This gene encodes a ubiquitous cytosolic phosphoprotein proposed to function as an intracellular relay integrating regulatory signals of the cellular environment. A possible role for this gene in growth regulation, as well as its expression pattern and chromosomal location, suggests an involvement in the development of neuroblastomas and melanomas. |
| SNX5 | 2.78 | 1.65 | 3.55 | Hs.13794 | Unknown (This gene encodes a member of the sorting nexin family. Members of this family contain a phox (PX) domain, which is a phosphoinositide binding domain, and are involved in intracellular trafficking.) |
| SUCLA2 | 2.63 | 3.36 | 2.13 | Hs.182217 | forms succinyl-CoA from succinate with a concomitant hydrolysis of ATP |
| TFR, CD71 | 5.28 | 2.86 | 4.07 | Hs.77356 | binds and internalizes the iron carrier transferrin |
| TFR2 | 9.00 | 3.01 | 3.41 | Hs.63758 | binds and internalizes the iron carrier transferrin |
| TNFSF13B* | 2.35 | 5.03 | 2.00 | Hs.270737 | This cytokine is expressed in B cell lineage cells, and acts as a potent B cell activator. It has been also shown to play an important role in the proliferation and differentiation of B cells |
| TYMS | 6.37 | 7.46 | 6.12 | Hs.82962 | catalyzes reductive methylation of dUMP to dTMP |
| VLCS, VLACS | 6.36 | 3.05 | 5.75 | Hs.11729 | convert free long-chain fatty acids into fatty acyl-CoA esters, and thereby play a key role in lipid biosynthesis and fatty acid degradation. This isozyme activates long-chain, branched-chain and very-long-chain fatty acids containing 22 or more carbons to their CoA derivatives |

[1]Genes marked with an * have been confirmed by qRT-PCR

[2]Unigene cluster numbers are given when available. Those numbers in parenthesis indicate the Genebank assession number for those genes that have not been assigned Unigene Clusters.

TABLE 3

Over-represented genes also found to be differentially expressed in recent microarray studies.

| Gene Name[1] | Human Unigene ID | Mouse Unigene ID | Ave Fold Change[2] | Santos Mouse[3] | Ivanova Human[4] | Ivanova Mouse[5] | BM SAGE |
|---|---|---|---|---|---|---|---|
| HLF* | Hs.250692 | mm.45146 | 27.99 | no | YES | YES | YES |
| HERMES* | Hs.80248 | mm.12436 | 20.71 | YES | YES | ND | YES |
| CD110* | Hs.84171 | mm.4864 | 8.47 | YES | no | YES | YES |
| ROBO4* | Hs.111518 | mm.27782 | 8.35 | no | ND | YES | YES |
| HOXB6 | Hs.183096 | mm.215 | 6.07 | no | YES | no | ND |
| GATA3 | Hs.169946 | mm.606 | 4.38 | YES | YES | YES | ND |
| SOCS-2* | Hs.351744 | mm.4132 | 4.35 | YES | ND | no | YES |
| SPTBN1 | Hs.107164 | mm.3601 | 3.89 | YES | no | no | YES |
| MDS1 | Hs.54504 | mm.56965 | 3.82 | no | YES | YES | ND |
| KLF4* | Hs.356370 | mm.4325 | 3.28 | no | ND | YES | YES |
| TRAIL | Hs.83429 | mm.1062 | 3.00 | no | Yes | ND | YES |
| GBP2 | Hs.171862 | mm.24038 | 2.97 | YES | ND | ND | YES |
| DKFZP434J214* | Hs.12813 | mm.21712 | 2.79 | YES | ND | ND | YES |
| CEBPB | Hs.99029 | mm.4863 | 2.23 | YES | YES | no | YES |

"YES" signifies that the gene was over-represented, "no" that the genes was not over-represented, and "ND" that the gene expression was not determined.
[1]Genes marked with an * have been confirmed by real-time PCR. (FIG. 5)
[2]The average of the fold-changes from BM, CB, and PBSC.
[3]mouse SP cells from table S3 of Ramalho-Santos et al. ((2002) Science, 298: 597-600)
[4]human fetal liver HSC from database S3 of Ivanova et al. ((2002)Science, 298: 601-604)
[5]mouse BM and fetal liver HSC from table S2 and database S2 of Ivanova et al. ((2002)Science; 298: 601-604)

Equivalents

Those skilled in the art will recognize, or be able to ascertain using no more than routine experimentation, many equivalents to the specific embodiments of the invention described herein. Such equivalents are intended to be encompassed by the following claims.

SEQUENCE LISTING (168 sequences)

SEQ ID NO: 1 - DNA, 1292 bp, Homo sapiens
  modified_base (6)..(6): a, c, g, t, unknown or other
  modified_base (1259)..(1259): a, c, g, t, unknown or other
  modified_base (1266)..(1266): a, c, g, t, unknown or other
  modified_base (1282)..(1283): a, c, g, t, unknown or other
gcgganctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatacttaaatggttgttctgggtcaatactgccttaatggggacatttacacattctcacattgtaaagttttcccccctatttggngaccatnattactgtaaaatggnntttgggttt

SEQ ID NO: 2 - DNA, 3076 bp, Homo sapiens
gaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcaaagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcatctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaatacctggttttttttttgttttgtttttttgtacagacagggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattc

SEQ ID NO: 3 - DNA, 983 bp, Homo sapiens
gtggaattcatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcaaaaaaaaaaaaaaaaaaaaaaaaaaaaaaaaaaaa

SEQ ID NO: 4 - DNA, 1125 bp, Homo sapiens
gtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctac

SEQ ID NO: 5 - DNA, 610 bp, Homo sapiens
  modified_base (59)..(59): a, c, g, t, unknown or other
  modified_base (76)..(76): a, c, g, t, unknown or other
  modified_base (82)..(84): a, c, g, t, unknown or other
  modified_base (403)..(421): a, c, g, t, unknown or other
  modified_base (501)..(501): a, c, g, t, unknown or other
  modified_base (597)..(598): a, c, g, t, unknown or other
ccacttccacgggacagtatgcatgttacgatttaatcggctcactataggaatttgcntcgaggccaagattcgnacgagnnngttcaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacannnnnnnnnnnnnnnnnnnagagaatcccctccatctttgggaggggttgatgccagacatcaccaggttgtagaagttgacaggcagtgccatggggncaacagccaaaataggggggtaatgatgtaggggccaagcagtgcccagctgggggtcaataaagttacccttgtacttgcaaaaaaaaaaaaaannaaaaaaaaaaaa

SEQ ID NO: 6 - DNA, 4307 bp, Homo sapiens
  modified_base (2430)..(2436): a, c, g, t, unknown or other
  modified_base (2439)..(2439): a, c, g, t, unknown or other
  modified_base (2625)..(2625): a, c, g, t, unknown or other
  modified_base (2629)..(2629): a, c, g, t, unknown or other
  modified_base (2631)..(2634): a, c, g, t, unknown or other
  modified_base (2637)..(2637): a, c, g, t, unknown or other
  modified_base (2781)..(2781): a, c, g, t, unknown or other
  modified_base (2783)..(2784): a, c, g, t, unknown or other
  modified_base (2787)..(2787): a, c, g, t, unknown or other
  modified_base (2831)..(2831): a, c, g, t, unknown or other
  modified_base (3036)..(3036): a, c, g, t, unknown or other
  modified_base (3991)..(3991): a, c, g, t, unknown or other
  modified_base (4039)..(4039): a, c, g, t, unknown or other
  modified_base (4043)..(4052): a, c, g, t, unknown or other
  modified_base (4054)..(4056): a, c, g, t, unknown or other
  modified_base (4058)..(4065): a, c, g, t, unknown or other
cttcaaagggttgagtctgggggctcatcagaagaggtaatcccaagtgacttggaatctgcaacaggtgggttaggacctcatccttagatattgctttaaccaatttatgggtaagccatagttctgagcagagtcacgtgctcacgcgccccacgtgtagtgacaacgggaatgtaggcttaaacataggtaacagcttcaaaagagtttgtaaaaacaaggctgtgaatatcaatataattgtgagacttttggggatttattgtaggtttgaacgtaacttgaaatacagtgatttgtagacagtcagtaattgcttcacttgctccatttggaattttgtaactattcacttctccagcagcataaggtggttaagaagacagtttctgttcgttgtaaaaaattactccaggcttaaggaggacaattattgtgtctttatattcatatacccaggatttagcacagtgcctaatccataagggccacactaaaatgtttgcccagtgaataaatcctggataatatcatcctgtctgcaaagccagtattacagagtgattggttgccagtaggggagatagctccctttggttacacaaattgtggcagacattgaaccactccaaaagaaactaaagctatttatttggggattgaaacaaaaaagcctacacaacttgaaaaaagcataaagacactcagatggaaccatagtgtctcccagcagatatcaccagatgggggtgggggtaaataattgcagtcacatatgcagcaggtatatatatttttactaatggcttattcttaaacaggacttgaggccagagaaatttcaaggataaattgctttgggagaatgcctgatatcaatgtctcctgagacatagaagttttccaaaataacaaatcaccagatatattattttgttgcctcctcttccttcccctggcccctgccaatatgcttatttacaagagttaccttatcagttgtcttaggagaacacatttccttcaacagaagtcacagtatcatcttatggtcataattttacaatatccctgcctctactgagaagagatacatagcgaatggagatgtgctgagccaatgaggaattaatcctaggcagcactagtagatgtggccacagctctggccccaccccactctggtggtcaggccaaaaaagaagtcaggtaagaagtgtgaaaggaaattcaatcttgggacccccaaactcattaagccacagggaaaattcaagctgggaactgggtcacgcaaacatgcctcccccttttggttcctaaataagatggctacaagatgaaaagctacatgcctcccccatattttgcccacaagggaattcccagtgagctgctagatctttacactaaaggtgtttctattaaaatttcaccatggcaatataaattgatagtttatagatgcagtcacccctggcccaccagacacaaatgcatatctgattgttcccctggcccagttttgtctgttatcttatataaaatgcagattccctgcaattttcctctgcctcatttgtctgtgtcatcttatgttaaaaaaaaatgcagattcactgagccagacaaaggcatgaatgactatttttccctacccacctcttacatgaaaattgtgtacttctcaatatcctgccctttcccctttaaatttggagccttcaaaatcatctttggggaaaggcatagacctgtctcctaggtgtgcatccttaactttggcaaataaacctcctaaaataattgagacttgtcatttttctcgattgacagaagaaaagacagagccaagaggatggcagtgtacttggctacccccagagcctagctgaggctccagccctgggcacttcactggagcattcccttgccagcagaggaacctgcagcctaacctcatgctggggtaaccttaatgtgggcaatccgtcttactgtaatagacaaattgcctgctttcacttaatccacagatttacaagggacaaactttggccctaggaatatttattgaatatcatttcatccttgtgacttccacttctttctgattcccatatcaccagcccaagagaacttgagtatctgttcacagctttgctcctctttccccacattaaccacaaagcaacggaaatagaataaagagacaaatgggtaactctaagtaggttcatcacattcattacatgccctgtatccagagccaatataaatggtcttgattctgattgtgttgaggtataaaaacatgctgatttctgtggcaggtattaatgattattacttgtgtattcatttgctcactgctccattctggatgttcttggtctcagggcctaaggatcattttctcggatgcannnnnnntcntcttccggctcagttcctccagtggtgtgcgggccaccctcagactgtacgcagagagctacgagagggatcccagcggccatgaccaggagccacaggcagtgctgagccctctcatagccatcgcactgaaaatatcccagattcatgagagaactggccggaggggacccactgtcatcaccngaanannnnaangatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaananntcnatttggttttggttttgtcctattcctccaaatgcagcagggcntttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggnaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggacntttagtggccaataaaaaagaaattcctaatttcaaccttaaaaaaanaaannnnnnnnnnannnannnnnnnntctcaccagttgagaaactccagtactggtcacctatcctgataaatctgcctttcagaaaacctgcaagggctgtttttcactattatggcaagagacatgtattaaatggaacaggaaaggtaagttactcaaaactgcctttgggagtcagcagaaactgaaatggcatctagaccttcactgtaactgtcttcatttcaaattaataggaagtggcgtttgaactgagattctaaaac

SEQ ID NO: 7 - DNA, 2976 bp, Homo sapiens
  modified_base (97)..(97): a, c, g, t, unknown or other
  modified_base (115)..(115): a, c, g, t, unknown or other
  modified_base (125)..(125): a, c, g, t, unknown or other
  modified_base (145)..(145): a, c, g, t, unknown or other
  modified_base (778)..(778): a, c, g, t, unknown or other
  modified_base (1080)..(1080): a, c, g, t, unknown or other
  modified_base (1915)..(1915): a, c, g, t, unknown or other
  modified_base (2666)..(2666): a, c, g, t, unknown or other
  modified_base (2949)..(2950): a, c, g, t, unknown or other
gttctatattctctaaatatgaaagtatccagaaaggccagtggtagtaaaaagcttagtgtatataatctcaaaagggatggaatatttacagctncatatttataacatgttngaatcttctncagttatcagtagtcatcanaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtanaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtntggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacnaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagngagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgcaannaaaaaaaaaaaaaaaaaaaaaaaaaa

SEQ ID NO: 8 - DNA, 4254 bp, Homo sapiens
ggggactacccagagggctgccgccgcctctccaagttcttgtggcccccgcggtgcggagtatggggcgctgatggccatggagggctaccggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacaatgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaagtgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggctctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagcgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaacgtagaagaaagaacattattattctttaattcctacaaggtacttgaaaaccttaagtgaaaaagatttctatctttttatcttggcgcatttatggaaaaaatattaactgtcctgaatattttataattttgtaggaaaaatatgcatctattttttcttgacttcttttatatagtaataaaagttattttggaaaaaaaaaaaaaaaaaaaa

SEQ ID NO: 9 - DNA, 3576 bp, Homo sapiens
  modified_base (158)..(158): a, c, g, t, unknown or other
  modified_base (864)..(864): a, c, g, t, unknown or other
  modified_base (898)..(898): a, c, g, t, unknown or other
  modified_base (1946)..(1946): a, c, g, t, unknown or other
  modified_base (2044)..(2044): a, c, g, t, unknown or other
  modified_base (3553)..(3553): a, c, g, t, unknown or other
  modified_base (3574)..(3574): a, c, g, t, unknown or other
tgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtanttttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgantatattcagtttcccactttaggcaaaagtaganttaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgtncatacctcttctctacctaattgttcatttaaatttcagccttattccttgataagggattttaccacatgaagtcatccagtgaccctagctcttantgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttnaaaaaaaaaaaaaaaaaaaanaa

SEQ ID NO: 10 - DNA, 2484 bp, Homo sapiens
  modified_base (1001)..(1001): a, c, g, t, unknown or other
  modified_base (1385)..(1385): a, c, g, t, unknown or other
  modified_base (1590)..(1590): a, c, g, t, unknown or other
  modified_base (2196)..(2197): a, c, g, t, unknown or other
  modified_base (2227)..(2227): a, c, g, t, unknown or other
  modified_base (2240)..(2240): a, c, g, t, unknown or other
  modified_base (2434)..(2434): a, c, g, t, unknown or other
gtttggaagtgatagcaaataaaagccaccttgaactgggtctgatgcagcattcttaccaaacttcaaacctggactagttcatccttatgcattgaggcttttttattcgtgttcgtttgtttttaccagttaactatcaacataaatttcatttataatattgtatgttcagtgttccaaaaaactggtcctaccaacatagtttggaatgactccattataagatggtgactgcctgtatcaaatctttactgcctttttcaaattcttaccatttttataaaaaggagtcacactactcaatctatacatcagtgttaaatatgatttttactaattttttttttttttaccaacactatcttaaaaaatctgacagcatagagcagtgattaaaggcatttgcttcagggtcaaatatagttacactgctgttttttggacaatttgttattttgaaccattgtttcttacctttataaaatgagcataagataatgttcttttaaggtgagtatgagatacaaatgagaaaagcaataataataaagattcaacaatggaaactgctatttacattatgattgttataattagaaggacaaactgtaatttaacgttcctatagtaataaaatggcatctacagagcaaatctaaacagacttaatcttcatataacaattcatcccagataatttgaattgaccataataacatgtttgaaaggaggctgaaataaaacagggtttgctcttttcaactctttagccaagactttttttaaaaaaaactggtatataaatgctttgtatttcctttcaagtttgaagggaaaataaatataatacttaatagattttcaagtatctctttagacattctcttgtttaggcttgtactaatccattcattcagggtttgactgttgggtgaacttctttgccctattcccagctgtgagaggcaattctccaggtttctaagctttagacctangcccttctctgatgaggttaattagggtttgggctgaaacccagattcctatatatgtggatagagtgatgtagaagtactttatgataataaatataaatgaaatttagattttaatttagaaatagaaaacatttaggcaactcactgaatcaaaaataaatatagacaaatttaattaatatatttatttattatattttcctgggttgggctttggcctctatttcatatattttgtttatttttcaggatgttctgggataatgtagtccaggttctagttctgcctttgtcacttactagccatctagtcatataatgctgaaaaatatattatgtagctctaagataaattcaacgtacctgcatagcactattcancatacttgcacagtattattgtcaatatgtagtctaacagataagaaaccactgtgaaaatagtaaaccattataaaaaatgatgttttataatgatacatctttgcacttctaatattattgctttaaataaatgtggtatatattcagcatacagccaaatttacaaaattttatctttttaattttatgtcatatataaagnaaccttaatgccaaaataatctttatagtgatgactcgacatcccaaaaatgtgggacccaacagggacattaataaagagataaagcaggctctgtgccgacttgttagaatttggtacgtggcaaatgtgcagtcacacggccttaaacctcccctgggaaactgctcaaacatttgcattcccacaatgtatttattcaggaaatactcttttcctgagaaaaatctggctctcaaacctctccctgagattatgcaagttctccattggggaaatacagttggaaatctagtaaagaatgtttattaacaaaaatccatttgcagatcctagttattctcaatattttgtggatttacaattgagaatactacttgcaaaaagtaaacttcaaaaaaaggaaatagaaagctatcagaattcctgtagagtttgttgttccccttctcctccaacatagttttattctaatgttttctttattcattttctttggtattagtgtgctgtaaactcacccaaaatgaaaaacaatcaaaataaaataaaacaaaatgaaagcacatcagttaaagataaaacaaaacaaaaaacaggctgccnnggttttagtggacagaagggtaggcccccntggagatcagccnaaattgagtggatggaagtaatcaacaacaagaggacaacaacattagccactgctgagcagaaaattagaaagattcttcaatttatttttttttcttttctggttgtcaggttttgtctctcctgtcttccactggtacaccataaatcagcagctaaaatgaaatttccttcttttagacatggcaaagtnctcattgagcttagagattaatagtaaaactttaaaaaaaaaaaaaaaaa

SEQ ID NO: 11 - DNA, 2643 bp, Homo sapiens
taaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttggataggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaacgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttacgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatcccacgg

SEQ ID NO: 12 - DNA, 502 bp, Homo sapiens
  modified_base (462)..(462): a, c, g, t, unknown or other
attttcttcactatagatgtctttgtgagaaggtttggtacttttcaaaacctgttggtcttagaaagaagaaggtaagaattgtgaaaagctgattgcgactggtgcccttgtaggtcaataatgtctattttgatgtggcctgaatatttcacttcattttatatggtcggatgctccatgttaggattaaggggtaattaatagtaatgtatgtggaattcagtgtgagttgattcattcatctgattctgtatttaatatctaaatgggatcagtgacactggtaggatgggtgagagaagaaaattggctaaaattgcatcatggaagatcaggcttggatggggtgccataggtgggcctgaggggcaacatgagatcccaggagcacaaacttagaggggtgttgaaagataccaagacaaactgtctgctttaacattttgccaacagcccttntgagcctcaagaaaaaaaaaaaaaaaaaaaaagagggggg

SEQ ID NO: 13 - DNA, 2071 bp, Homo sapiens
catcaccctttttaacattgtttacacatcactgcctgttttagccatggggatttttgaccaggatgtgagtgaccagaacagcgtggactgtccccagctctacaaaccaggacagctgaatctgctttttaacaagcgtaaattttccatttgcgtgttgcatggaatctacacctcattagtccttttcttcatcccctatggggccttttacaacgtggctggagaagatgggcaacatattgctgactaccagtcctctgcagttacatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgaaaaaaaaaaaaaaaaaa

SEQ ID NO: 14 - DNA, 2204 bp, Homo sapiens
gaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcagctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattggcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagctctcattcacactccttaagatttggtcagaatttttatttctgttcatgtcttctacttttctactcctgtatgaataaaatattgatttgattacagtggctttgactataatgtgggagccaatttttgcctcagtcttcatttttatatttaccttgttattctcaggcatttttttcttctatgtgagagttaaaatcattctgtaatttccccccaaaatcatattggtattctagttggcaatgtcttacatttatgttaagtttgagggaattggtagttcaagtataagttaattaaggccattttatttctaagtgaacagacttgaaactccagagctactgaagtaaaagttagaatcatttgcattttcattcagataggagataattttgtaaattttgatgctattattttaactctattagcttaagtaatgtcataatagaaaacacaagcatttgaccaaatgagatccattcagcgactaactggcaaggcactcaaaacatgtcattcattaaatgttgtttttatttacctcaaaaaaaaaaaaaaaaaaaaaaa

SEQ ID NO: 15 - DNA, 1671 bp, Homo sapiens
  modified_base (60)..(60): a, c, g, t, unknown or other
  modified_base (66)..(66): a, c, g, t, unknown or other
  modified_base (69)..(69): a, c, g, t, unknown or other
  modified_base (78)..(78): a, c, g, t, unknown or other
  modified_base (294)..(294): a, c, g, t, unknown or other
  modified_base (306)..(306): a, c, g, t, unknown or other
  modified_base (336)..(336): a, c, g, t, unknown or other
  modified_base (396)..(396): a, c, g, t, unknown or other
  modified_base (401)..(401): a, c, g, t, unknown or other
  modified_base (452)..(452): a, c, g, t, unknown or other
  modified_base (455)..(455): a, c, g, t, unknown or other
  modified_base (460)..(460): a, c, g, t, unknown or other
  modified_base (505)..(505): a, c, g, t, unknown or other
  modified_base (511)..(511): a, c, g, t, unknown or other
  modified_base (547)..(547): a, c, g, t, unknown or other
  modified_base (562)..(562): a, c, g, t, unknown or other
  modified_base (605)..(605): a, c, g, t, unknown or other
  modified_base (1098)..(1098): a, c, g, t, unknown or other
  modified_base (1601)..(1601): a, c, g, t, unknown or other
gtttaaaaaaaaaaaaaaaaaaaaatgtatatacctgtatgtgatccaccacccttttgnaggggncanctggtcctncggttggggctgcaggtgtgcctgacatttgcaaaagatattccagtctttcgatgttcagaattgaaaatgtggagatagaaaagctcaaacagactcctaaaaggagggtttctttcctgaagactccaagaaaatgagtgtgcagatgagttagcttgacaacctcaactctggggagcaggcaggcggtctgaggaagataagggcccacgncccactcacctnggcacctgttcggtggtcccggggcatcanggtctgcagctctgggcccccagccccactgtgaagtcagtcctgcatgctggccgaggnccggncacctcccgatgcctccagagtcagtgggaaggagtcagcccttcccaganttncccgncacctccagcaggagcagctcagtttgtggctctgggagctccgnttttgnaaacccaaaaaggctgtgcatttggaagccaaacgntcagcatgcggctgnccgagtctggttttgtggacaaagcaaactgtggaatggcttnctcggtgtctgtataaagggacaaacggttgcattcaccctttgtactataacaccgcttctgcattcgccatatccgttttttaacctttttgtctccggggaacttctcattcgattattatgtcttctgatgatttgccatgttattttaaaggtgattttattttcttatggacaggaaaaaagaaaatgaggaggagttggttttactcttagagataagacttcagcaggggctcagaaaccccaaactctagttaaattgcttctcggaggaaaatcttaatctagacagattcagattcccaggctctcctggaagccctgcacttcagggcacaggggccctgggacgtggttggcagccaggctgcgagagagctaaaaaggaacaagaacatcagctcggatgtttgtctctcagccctgacacctgccactctccttcccggggcacttggccctatcagagggacatgaaatgctgtccnaatggtggcagaaatgcagcgacattgcatgcagcagagtctttgcttcgaaagatggggcgccatgtttcagagaacatttatcttagtcccacgttcaggtgagaagacctcaaaggtaccctctgtccagaataaacattggaacaatctctcaattggcttttgtcactacacataatgtaatctcccttctttcagctcccccaacagtgagcatgcttcccaaaaaattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcactgcaaaattgttcatgggtctatgtagcaaatgattctctgccttgacaatcatgtatacatatcaagatttctatcataatgataatgagattgatgacttcntgttttcctccaataaagacaattaatcaccttcaaaaaaaaaaaaaaaaaaaaaaaaaaaaaaaaaaaa

SEQ ID NO: 16 - DNA, 2157 bp, Homo sapiens
  modified_base (248)..(248): a, c, g, t, unknown or other
  modified_base (911)..(911): a, c, g, t, unknown or other
  modified_base (1000)..(1000): a, c, g, t, unknown or other
  modified_base (1311)..(1311): a, c, g, t, unknown or other
  modified_base (1590)..(1590): a, c, g, t, unknown or other
  modified_base (2107)..(2107): a, c, g, t, unknown or other
  modified_base (2111)..(2123): a, c, g, t, unknown or other
  modified_base (2125)..(2126): a, c, g, t, unknown or other
  modified_base (2137)..(2147): a, c, g, t, unknown or other
gaatcggccgaggccatcccggggctggcgggcgggggtgggcagtgggtgtgaggccgcccctgcgtcccgggggccccccgaaaacgcgctccgggtgcccggtccctccgctgcgccctgccgccgtcctcccgggggtctcgtggcggcctgctggccgtgtccttcgctgtcccgtgcggctgcggctgggaggggcctggcgtgacgcagcggttgctacgggccgcccttataaataaccngggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggcngccaagggcgcgctgcaccccggctgcttcgcgcccctgcacccaccgcccccgccgccgccgccgcccgccgagctcaaggcggagcngggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcnaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccncggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttanaaannnnnnnnnnnnnannaaaaaaaaaannnnnnnnnnnaaaaaaaaaa

SEQ ID NO: 17 - DNA, 1947 bp, Homo sapiens
ggcttactcactatagggctcgagcggccgcccgggcaggtctagaattcagcggccgctgaattctagcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttcaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctaaaaaaaaaa

SEQ ID NO: 18 - DNA, 717 bp, Homo sapiens
gtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaacgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgaaaaaaaaaaaaaaaaaaaaaa

SEQ ID NO: 19 - DNA, 439 bp, Homo sapiens
ttgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtg

SEQ ID NO: 20 - DNA, 1295 bp, Homo sapiens
cagcttctagctctcagtctgcgcgagggtgtaggaaggaaagcccaggacctccggagcagacagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggacgtggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctggagggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtatttcccagccttgagcgcacgcacacaccacacacatacacacacgcattatttttgttactttgcttctttttatgtttgtaatctgtaaatgaacacatggcagaaaataaccctgattggtagg

SEQ ID NO: 21 - DNA, 2958 bp, Homo sapiens
  modified_base (151)..(151): a, c, g, t, unknown or other
  modified_base (210)..(214): a, c, g, t, unknown or other
  modified_base (216)..(217): a, c, g, t, unknown or other
  modified_base (219)..(219): a, c, g, t, unknown or other
  modified_base (221)..(225): a, c, g, t, unknown or other
  modified_base (227)..(227): a, c, g, t, unknown or other
  modified_base (230)..(233): a, c, g, t, unknown or other
  modified_base (1443)..(1443): a, c, g, t, unknown or other
  modified_base (2911)..(2911): a, c, g, t, unknown or other
caagcagttaatacagactcaccaagagaacggaattgaaatttgcatggactttctgcaaggcacttgtatttatggcagggattgtttgaagcaccacactgtcttgccatatcattggcagatcaaaaggacaactactcaaaagtgncagagtgtattcaatgattctcaggagcacttggaaagattttactgtaacccagaaannnnnannangnnnnngnagnnnngaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttnaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaanttatggtaattctttaaaaaaaaaaaaaaaaaaaaaaaaaaaaaaaa

SEQ ID NO: 22 - DNA, 4198 bp, Homo sapiens
ctgctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgacattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaattcaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctgaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaacggtaattacaacatattatcagtcacagttttctttccaattaaacacttaacttttgttattccctgtatataaatatataacacacattttctagattcacaaatttaaataaattactcaaaaaatg

SEQ ID NO: 23 - DNA, 919 bp, Homo sapiens
  modified_base (250)..(253): a, c, g, t, unknown or other
  modified_base (276)..(276): a, c, g, t, unknown or other
  modified_base (284)..(284): a, c, g, t, unknown or other
  modified_base (312)..(312): a, c, g, t, unknown or other
  modified_base (834)..(836): a, c, g, t, unknown or other
  modified_base (838)..(850): a, c, g, t, unknown or other
  modified_base (853)..(855): a, c, g, t, unknown or other
  modified_base (857)..(857): a, c, g, t, unknown or other
  modified_base (859)..(859): a, c, g, t, unknown or other
  modified_base (861)..(862): a, c, g, t, unknown or other
  modified_base (908)..(908): a, c, g, t, unknown or other
caggatggtgagagatcctgaaagagctgcctatattataaattatatacatttttttttaaggaaaagtgtggaggctagggcaggcaggttgttaggactgaaggtttgcccattctgctgcctccatctcagctccagctccatccccctctccacagaaagcagttggtgacacgaggttctatacttttcttctgttgctctcttgacttaacgtgaaaacagggtatatttgaacaaactgtcnnnnccaggcaggggctgggcagggcntgtgtgcnttgctcagcctcctgacaggacactttngttgcacttagaatttacattttaatggatgtaaaaacaactgtgagagatgtctgggcctgcagaagtccagcattgctcaaaaaagcgtgtgttctagtgaacattttcatatatatttattggttatagcctgttaaaatattttcttttttgtattatttatccccctacattatgtatttatatgagggaaaaaaaggaaaaaattgtacttttttagtatttacctgttacaaaggacattgtgtttcctgtcatgtaaaaccagctattttagttactattgtactctagaaaagagctgtagatttatgttaaactcgtacttacgaacaattgtaattagttctaaaaggcatgaactcagctcctaatcgtcactgtatagtcctgaatttgtagaactagagttaattccctcttggaactttctttgttcttcagtagttacttttttccttacctaaaagggttgtctgtcaaacaattcttgaataaactttctgttatcaattttannnannnnnnnnnnnnnaannnananannagagcaaggctgctggactgccaaatttcccccaagggaggagggncaaggacaagg

SEQ ID NO: 24 - DNA, 1002 bp, Homo sapiens
  modified_base (508)..(508): a, c, g, t, unknown or other
ttttttttttcattttagtggaaatggggttttaccatgttagccaggatggtctcgacctcctggcctcatgatctgcccacctcatcctcccaaagtgctaggattacaggcatgagccaccgcgcccggcccatatatagtcttttaaaatgtagtatcaggaggcaaaagaaagcaagaaaactttctggaggacagtttttcctaaagcaaaaaataaatggctttactaacaaatcacttcagaaattccatgtattcagttttgtaatcttggggagagaaggaatttctaaatgtcataaagataaaagccataaatgaaaatattaatgatttcactgcataaaaacttaataccacatcaaatgccagaaataaaatgaaaagtcatataacctgagatggatggcagaaaaatgggttaacatccttagtatacaggaacctcttgcatatgagttaatcagaagcagccacagattccaatagaaaaatgggctancaatgaaaaattcaccccccaaaatgcagattgccattgaagataggaaatatgttcaaacttattagtagtcaaatgtaagctcaatttgcacctatagaattggcaaaaaatgagaaattaattataatacccgtgtagtaaaatggacactctgttgtactattggtcattgaatcaaagcagtcttgacagtatgcaaaatccttaaaatcatggacacttttgatcaagcaattccatatgtaagagtttatcctaagcaaatcattaggatgttggtcaaagtgtacagtgttaggaggaatacattttttgagataacactgcacaacatggtaactacagttaataatggtggtgctgggcacggtggctcacacctgtaatccccgcaccttggaaggctgaggtgggtggatcgtttgagcccaggaattcgagaccagcctgggcaacatggtgaaaccccatctctaccaaaaaaaaaaaaa

SEQ ID NO: 25 - DNA, 3775 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcccaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaaggcagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 26 - DNA, 2315 bp, Homo sapiens
ggcacgagggcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccatacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaaaaaaaaaaaaaaaaaa

SEQ ID NO: 27 - DNA, 2107 bp, Homo sapiens
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgtttt

SEQ ID NO: 28 - DNA, 2645 bp, Homo sapiens
gcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcgtcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagcgcacacaccaaaatccaaccttctaataaacatgatggcgcagtcccaaaaaaaaaaaaaaaaa

SEQ ID NO: 29 - DNA, 1792 bp, Homo sapiens
  modified_base (155)..(155): a, c, g, t, unknown or other
  modified_base (217)..(217): a, c, g, t, unknown or other
  modified_base (594)..(597): a, c, g, t, unknown or other
  modified_base (643)..(645): a, c, g, t, unknown or other
  modified_base (647)..(647): a, c, g, t, unknown or other
  modified_base (651)..(651): a, c, g, t, unknown or other
  modified_base (972)..(972): a, c, g, t, unknown or other
  modified_base (1556)..(1556): a, c, g, t, unknown or other
  modified_base (1591)..(1591): a, c, g, t, unknown or other
  modified_base (1603)..(1610): a, c, g, t, unknown or other
  modified_base (1612)..(1615): a, c, g, t, unknown or other
  modified_base (1617)..(1622): a, c, g, t, unknown or other
ctcatgctgttcagatagcgctgatggccctgaagatgatggagctctctgatgaagttatgtctccccatggagaacctatcaagatgcgaatggactgcactctggatcagttttgctggcgtcgttggagttaaaatgccccgttactgtcnttttggaaacaatgtcactctggctaacaaatttgagtcctgcagtgtaccacgaaaaatcnatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaannnnatgtactcacttcagtacttcagctcttcaagaaaaaaaaaaaaannntnaaanagctactttggtgggagtatttctattatataaccagacttactaccggtactcaaaattcagcaccttgtacatatatcagataatggtagtcaatggtacaaactggatggagtcacctgcaatctcatatccggggggaatgccagggttattaacagtgtgtctggtgatagtgtcgtcaaaaaaaaggttttggaatagaaattacattctttgacaccctcagttctttcaaactttcaactctgcatttaatggcattttctcatttaactggtgagtatatgttggaatataggcggactttttttctctatngcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctntgaactaagaatcaagtttttgtctcattaaatanacatatatgaannnnnnnnannnnannnnnnatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttaattaggtcagttgaagtc

SEQ ID NO: 30 - DNA, 3180 bp, Homo sapiens
  modified_base (1035)..(1035): a, c, g, t, unknown or other
  modified_base (1760)..(1760): a, c, g, t, unknown or other
  modified_base (2463)..(2463): a, c, g, t, unknown or other
  modified_base (2755)..(2755): a, c, g, t, unknown or other
  modified_base (3132)..(3136): a, c, g, t, unknown or other
  modified_base (3138)..(3138): a, c, g, t, unknown or other
  modified_base (3140)..(3140): a, c, g, t, unknown or other
  modified_base (3172)..(3177): a, c, g, t, unknown or other
cccccccccgccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagncagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggngaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttagggnaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggngctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgnnnnnananagtttttatttcaataaaaatattaacattannnnnnaaa

SEQ ID NO: 31 - DNA, 2188 bp, Homo sapiens
gggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcgggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaaaaaaaaatcagcgcacttgcgcgtcccccccccacccccttttttaaacaagtgttacttgtgccgggaaaattttgctgtctttgtaattttaaaactttaaaataaattggaaagggagaaaaaaaaaaaaaaaaaaaa

SEQ ID NO: 32 - DNA, 773 bp, Homo sapiens
ggcacgaggctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccaccactgatctcaataaaagagctggataatttctttaaaaaaa

SEQ ID NO: 33 - DNA, 1712 bp, Homo sapiens
  modified_base (333)..(333): a, c, g, t, unknown or other
  modified_base (769)..(769): a, c, g, t, unknown or other
  modified_base (809)..(809): a, c, g, t, unknown or other
  modified_base (817)..(817): a, c, g, t, unknown or other
  modified_base (848)..(848): a, c, g, t, unknown or other
  modified_base (1058)..(1058): a, c, g, t, unknown or other
  modified_base (1090)..(1090): a, c, g, t, unknown or other
  modified_base (1109)..(1109): a, c, g, t, unknown or other
  modified_base (1132)..(1132): a, c, g, t, unknown or other
  modified_base (1140)..(1140): a, c, g, t, unknown or other
  modified_base (1156)..(1156): a, c, g, t, unknown or other
ttttgtttgttttctcgtgagcttaggctgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacngaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaagaaaatgtcttctgaggctgatctggtgtctcacatctgtaatcccagcacttggggaggctgaggttgcaaaagcttctcatttcagagagatgccaggatcctaagtgcctgccaaacttaccaattctaaggaataagtggatggatggcattactgattcctacattactgattgattctgcatccgcnaattgttttattaaaaacattctacatcatgtgtggggangataaggnaggataaaatgaagagaaagaatattattgnaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacnttttttcattcttgtcaggtagcagactgtgntagacttttctgcacttgnccttttcataacaatctatcttnggagaacntttccctatgagaacnatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaagggagaggaaa

SEQ ID NO: 34 - DNA, 589 bp, Homo sapiens
  modified_base (562)..(564): a, c, g, t, unknown or other
  modified_base (584)..(584): a, c, g, t, unknown or other
cattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaaannnaaaaaaaaaaaaaaaaaaanaaaaa

SEQ ID NO: 35 - DNA, 566 bp, Homo sapiens
  modified_base (406)..(412): a, c, g, t, unknown or other
  modified_base (414)..(429): a, c, g, t, unknown or other
  modified_base (433)..(435): a, c, g, t, unknown or other
  modified_base (522)..(526): a, c, g, t, unknown or other
ctctcggtgactactatcgctgtcatgtctggtcgtggcaagcaaggaggcaaggccgcgccaaggcaagtcgcgctcgtccggctggccttcattccggagcgagtgcatcgttgctgcgaaaggcaactacgcgggcagtgggggccggcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccaggggcgcgtcttgcctaacatccaggccgtactgctccctaagaagacggagagtcaccacaaggcaaagggcaagtgaggcnnnnnnncnnnnnnnnnnnnnnnncggnnncgagaagacgacagaaggggcacctgtgaactcaaaaggctcttttcagagccacccacgttttcaaataaaagagttgttaatgcnnnnnaaaaaaaaaaaaaaaaaaaaaaaaaaagtcgtatcgatgt

SEQ ID NO: 36 - DNA, 525 bp, Homo sapiens
agtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattcaaaaaaaaaaaaaaaaaaaaaaaaaaaaa

SEQ ID NO: 37 - DNA, 428 bp, Homo sapiens
  modified_base (230)..(230): a, c, g, t, unknown or other
tgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcncaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctcttacactccacggctcttcttc

SEQ ID NO: 38 - DNA, 823 bp, Homo sapiens
ggcacgaggcagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggagaattgtaaaaaaaaaaaaaaaaaaaaaaaaaaa

SEQ ID NO: 39 - DNA, 381 bp, Homo sapiens
atgcctgaacctgctaagtccgctcctgctccaaaaaagggctccaaaaaggcggtgaccaaggcgcagaagaaggatggtaagaagcgcaagcgtagccgcaaggagagctattccgtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtgcgcctgctgctgcccggggagctggctaagcacgccgtgtcagagggcaccaaggccgtcaccaagtacaccagctctaagtaa

SEQ ID NO: 40 - DNA, 730 bp, Homo sapiens
  modified_base (634)..(634): a, c, g, t, unknown or other
  modified_base (649)..(649): a, c, g, t, unknown or other
  modified_base (664)..(668): a, c, g, t, unknown or other
  modified_base (670)..(673): a, c, g, t, unknown or other
  modified_base (675)..(680): a, c, g, t, unknown or other
ggacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaaggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacncaggaaacataaagncaaaattaaaataannnnnannnnannnnnngctttctagggggtgcgccgctcaccaaattatccctttaggaggtcggc

SEQ ID NO: 41 - DNA, 2223 bp, Homo sapiens
acttcttttcttggctaagccgcgtttgtactgtgtcttaccatgcctgaaccggcaaaatccgctccggcgcctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggcactggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtttgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggcggcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttgctcagtttagcataacctcttatggattttcatcaaattcagcgtgttggtcactggaaagagccttttccttctccttttcttactctcccctcatggtgttcccctcttaaaggaggaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaa

SEQ ID NO: 42 - DNA, 845 bp, Homo sapiens
ctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctcttaaaaaaaaaaaaaaaaaaaaaaaaa

SEQ ID NO: 43 - DNA, 884 bp, Homo sapiens
  modified_base (416)..(416): a, c, g, t, unknown or other
  modified_base (569)..(569): a, c, g, t, unknown or other
  modified_base (610)..(610): a, c, g, t, unknown or other
  modified_base (618)..(619): a, c, g, t, unknown or other
gacaagttgctgggtaaagtcacaattgctcagggcggtgttctgcccaacatccaggctgtactgctccccaagaagactgagagtcaccacaaggccaagggttttagaagttcgcaatggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcntaccctggtggggctgtttgaggacaccaacctatgcgccattcacgccaagcgagtgactatcatgcccaaggacatccagcttgctcgccgcattcgtggggagagggcgtaaattgtcttgtgaatgtgtgctaaccaaaacccaaaggntcttttcagagccaaccaccttttctataaaagttgctgtntactgttnntgtccgtaaactggaacctctgttcactcaagggacgaggtctcactgtgttacccaggctggcctcaaaactccttagcttggccaggcgaggtggctcaggcctgtaatcacagcactttaggatgccaaggcgggcggatcacgtgatgccaagagttcgagaccagcctgccaacacattgaaacttcgtctctactgagaaatacagaaattagccgggtgtgggtggcacaacgccctgcaagtcccagctacatggaa

SEQ ID NO: 44 - DNA, 1237 bp, Homo sapiens
ctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagagccacccacatgcgcgctgaaaagatctgtttctctcaggaattcttcctggtacttgttttgcctgtagtagatagggcccatttccagacgttatacaatctgtttcgtaagactcagcctatccctttttgaatgctaattttgggagtcttaacatctaataatgtccggcatttttccgtaagcattgagtgtagccaaaagttccttcgtgtattgctctcccatctccgcagcccggttttgaccggatggtgcttctaattttctgctaacctgtactgtggtgtgtgtatatttcttgccaacacgccagaaataaaactaaggttgtactgaagttggaaaaattcaggttaatgtagctcatgctggctaaagtgaaacgttctctccccgccccccgttcctaagcagtgttaagttttctttgaattttttcaagccggattttgggcctgcttaaaccacttaaatgtagttaatgacagatggtttgaggtttaaaagtcttctggagaaagcccgccagagaacattccctttgaagccccatgtaaaaatacgtgtgggagagaaagtgttttctctgacttctgctgacagtggctaaaactctgaactgtcaggagtattcaaaataagactgccttgtaggtaagcctgtggtagtttttttgagcacaggataaaatacttgagtctttgcttaaatgttactttctcaatgaggctttgtatgactaaataaaatctgtataatccccac

SEQ ID NO: 45 - DNA, 1417 bp, Homo sapiens
  modified_base (18)..(18): a, c, g, t, unknown or other
  modified_base (22)..(22): a, c, g, t, unknown or other
  modified_base (34)..(34): a, c, g, t, unknown or other
  modified_base (36)..(39): a, c, g, t, unknown or other
  modified_base (42)..(46): a, c, g, t, unknown or other
  modified_base (49)..(49): a, c, g, t, unknown or other
  modified_base (56)..(56): a, c, g, t, unknown or other
  modified_base (74)..(74): a, c, g, t, unknown or other
  modified_base (124)..(124): a, c, g, t, unknown or other
  modified_base (141)..(141): a, c, g, t, unknown or other
  modified_base (162)..(162): a, c, g, t, unknown or other
  modified_base (192)..(192): a, c, g, t, unknown or other
  modified_base (203)..(204): a, c, g, t, unknown or other
  modified_base (224)..(224): a, c, g, t, unknown or other
  modified_base (228)..(228): a, c, g, t, unknown or other
  modified_base (240)..(240): a, c, g, t, unknown or other
  modified_base (245)..(245): a, c, g, t, unknown or other
  modified_base (248)..(248): a, c, g, t, unknown or other
  modified_base (267)..(267): a, c, g, t, unknown or other
  modified_base (279)..(279): a, c, g, t, unknown or other
  modified_base (305)..(305): a, c, g, t, unknown or other
  modified_base (311)..(311): a, c, g, t, unknown or other
  modified_base (314)..(314): a, c, g, t, unknown or other
  modified_base (319)..(320): a, c, g, t, unknown or other
  modified_base (325)..(325): a, c, g, t, unknown or other
  modified_base (329)..(329): a, c, g, t, unknown or other
  modified_base (334)..(334): a, c, g, t, unknown or other
  modified_base (337)..(337): a, c, g, t, unknown or other
  modified_base (339)..(339): a, c, g, t, unknown or other
  modified_base (351)..(353): a, c, g, t, unknown or other
  modified_base (362)..(362): a, c, g, t, unknown or other
  modified_base (369)..(369): a, c, g, t, unknown or other
  modified_base (376)..(377): a, c, g, t, unknown or other
  modified_base (384)..(384): a, c, g, t, unknown or other
  modified_base (397)..(397): a, c, g, t, unknown or other
  modified_base (410)..(410): a, c, g, t, unknown or other
  modified_base (540)..(540): a, c, g, t, unknown or other
  modified_base (650)..(650): a, c, g, t, unknown or other
  modified_base (730)..(730): a, c, g, t, unknown or other
  modified_base (765)..(765): a, c, g, t, unknown or other
  modified_base (886)..(886): a, c, g, t, unknown or other
  modified_base (995)..(997): a, c, g, t, unknown or other
  modified_base (999)..(1002): a, c, g, t, unknown or other
  modified_base (1006)..(1012): a, c, g, t, unknown or other
  modified_base (1014)..(1016): a, c, g, t, unknown or other
  modified_base (1054)..(1054): a, c, g, t, unknown or other
  modified_base (1406)..(1406): a, c, g, t, unknown or other
ggcagggtttggtttggntgtnttcagatttccntnnnntgnnnnnctnacaattnctctacagctcagaacancaactgctgaggctgccttgggaagaggatgatcctaaacaaagctctgntgctgggggccctcgcnctgaccaccgtgatgagcccntgtggaggtgaagacattgtggctgaccangttgcctcttnnggtgtaaacttgtaccagtnttanggtccctctggncagtncanccatgaatttgatggagangaggagttctangtggacctggagaggaaggagactgnctggcngtngcctnngttcngcanatttngangntttgacccgcannntgcactganaaacatngctgtgnnaaaacanaacttgaacatcntgattaaacgctncaactctaccgctgctaccaatgaggttcctgaggtcacagtgttttccaagtctcccgtgacactgggtcagcccaacaccctcatctgtcttgtggacaacatctttcctcctgtggtcaacatcacntggctgagcaatgggcactcagtcacagaaggtgtttctgagaccagcttcctctccaagagtgatcattccttcttcaagatcagttacctcaccttcctcccttctgntgatgagatttatgactgcaaggtggagcactggggcctggatgagcctcttctgaaacactgggagcctgagattccancacctatgtcagagctcacagagactgtggtctgngccctggggttgtctgtgggcctcgtgggcattgtggtggggaccgtcttgatcatccgaggcctgcgttcagttggtgcttccagacaccaagggcccttgtgaatcccatcctgaaaangaaggtgttacctactaagagatgcctggggtaagccgcccagctacctaattcctcagtaacatcgatctaaaatctccatggaagcaataaattccctttaagagannnannnnaaannnnnnnannnttcatccggggctgactgaacctatggctaagaattgngacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatntattctcaaaa

SEQ ID NO: 46 - DNA, 1763 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccagctacatcagatccatcaggtccgagctgagttgactaccactacttttccctttgtctcaattatgtcttggaagaaggctttgcggatccccggaggccttcgggcaccaactgtgaccttgatgctggcgatgctgagcaccccagtggctgagggcagagaccctcccgaggatttcgtgctccagtttaaggccatgtgctacttcaccaatgggacggagcgcgtgcgttatgtgaccagatacatctataaccgagaggaggacgtgcgcttcgacagcgacgtgggggtgtatcgggcggtgacggcgcaggggcggcctgacgccgagtactggaacagccagaaggacatcctggagaggacccgagcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgaccaggaggagacagctggcgttgtgtccaccccccttattaggaacggtgactggaccttccagatcctggtgatgctggaaatgactccccagcatggagacgtctacacctgccacgtggagcaccccagcctccagagccccatcaccgtggagtggcgggctcagtctgaatctgcccagaacaagatgctgagtggcattggaggcttcgtgctggggctgatcttcctcgggctgggccttatcatccgtcaaaggagtcagaaaggacctcaagggcctccaccagcagggcttctgcactgactcctgagactattttaactaggattggttatcactcttctgtgatgcctgcttgtgcctgcccagaattcccagctgcctgtgtcagcttgtcccccgagatcaaagtcctacagtggctgtcacgcagccaccaggtcatctcctttcatccccaccccaaggcgctggctgtgactctgcttcctgcactgacccagagcctctgcctgtgcacggccagctgcgtctactcaggtcccaaggggtttctgtttctattctctcctcagactgctcaagagaagcacatgaaaaacattacctgactttagagcttttttacataattaaacatgatcctgagttaaaaaaaaaaaaggaaatcgctgcagaatgaaggaatatcccttgaggtgacccagccaacctgtggccagaaggagggttgtaccttgaaaagaccactgaaagcattttggggtgtcaagtaagggtgggcagaggaggtagaaaatcaattcaattgtcgcatcattcatggttctttaatattgatgctcagtgcattggccttagaatatcccagcctctcttctggtttggtgagtgctgtgtaagtaagcatggtagaattgtttggagacatatatagtgatccttggtcactggtgtttcaaacattctggaaagtcacatcgatcaagaatattttttatttttaagaaagcataaccagcaataaaaatactatttttgagtct

SEQ ID NO: 47 - DNA, 2599 bp, Homo sapiens
  modified_base (3)..(3): a, c, g, t, unknown or other
  modified_base (5)..(5): a, c, g, t, unknown or other
  modified_base (8)..(9): a, c, g, t, unknown or other
  modified_base (17)..(17): a, c, g, t, unknown or other
  modified_base (54)..(54): a, c, g, t, unknown or other
  modified_base (318)..(318): a, c, g, t, unknown or other
  modified_base (406)..(406): a, c, g, t, unknown or other
  modified_base (642)..(642): a, c, g, t, unknown or other
  modified_base (706)..(706): a, c, g, t, unknown or other
  modified_base (1916)..(1916): a, c, g, t, unknown or other
  modified_base (2148)..(2148): a, c, g, t, unknown or other
  modified_base (2363)..(2363): a, c, g, t, unknown or other
  modified_base (2544)..(2544): a, c, g, t, unknown or other
ggnanganncagaggcngggatcatggtagatggaaccctccttttactcctcntcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaanctgcggacgctgcgcggctactacaatcagagcgaggccgggtctcacaccctgcagtggatgcatggctgcgagctggggcccgacnggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccnaaagacacacgtgactcaccaccccatctctgaccatgaggccaccctgaggtgctgggccctngggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcatggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttantccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccangggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgangccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtnttgagcatcaaaaaaaaaaaaaaaaaaaaaaaaaaaaaaaaaaaaaaaaaaaaaa

SEQ ID NO: 48 - DNA, 3865 bp, Homo sapiens
tttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttctttcttatttcttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaagaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaaaaa

SEQ ID NO: 49 - DNA, 2296 bp, Homo sapiens
gtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaaatggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaaggcccaggaacatgtttattttagtcacctttgctttttaacaattttgttttgtaatcaatgagtaattcatgatgaattatttttgactaatggatagccgaagcaagcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttctgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaatacctagatgtagatttatttaaaaaaaaaaaaaaaaaaaaa

SEQ ID NO: 50 - DNA, 917 bp, Homo sapiens
  modified_base (88)..(88): a, c, g, t, unknown or other
  modified_base (90)..(90): a, c, g, t, unknown or other
  modified_base (94)..(95): a, c, g, t, unknown or other
  modified_base (97)..(97): a, c, g, t, unknown or other
  modified_base (102)..(102): a, c, g, t, unknown or other
  modified_base (111)..(111): a, c, g, t, unknown or other
  modified_base (122)..(123): a, c, g, t, unknown or other
  modified_base (129)..(129): a, c, g, t, unknown or other
  modified_base (134)..(134): a, c, g, t, unknown or other
  modified_base (199)..(199): a, c, g, t, unknown or other
  modified_base (296)..(296): a, c, g, t, unknown or other
  modified_base (298)..(299): a, c, g, t, unknown or other
  modified_base (301)..(311): a, c, g, t, unknown or other
  modified_base (427)..(427): a, c, g, t, unknown or other
  modified_base (453)..(453): a, c, g, t, unknown or other
  modified_base (459)..(459): a, c, g, t, unknown or other
  modified_base (477)..(477): a, c, g, t, unknown or other
  modified_base (569)..(569): a, c, g, t, unknown or other
  modified_base (602)..(602): a, c, g, t, unknown or other
  modified_base (622)..(622): a, c, g, t, unknown or other
  modified_base (875)..(875): a, c, g, t, unknown or other
  modified_base (878)..(878): a, c, g, t, unknown or other
  modified_base (903)..(906): a, c, g, t, unknown or other
ctgcagaagtgatagtgggcttggggctacgcgccaggagagtctccccccacccacctttttcctttggttgctttttttttttttntnggtnntncctgncctttcctnccttccttttnnctcttntccgncccgcactccgtttcccggtttcccccctcgttggtaaggcgtttttatagtttatgtgacgtancaatcttggttgctggaatggctgtatcatagcgatatttatctcttcctgctcctcgataggccactggccctgcaccctttaccttctccactcntnnannnnnnnnnnngtatatgaacaaattttctagtcgagttttcaatgtgaatttgttcttacattatggctcccgaggggaagcgattactttttttaattttaaatttttttttttaattgcacttnttgtaaagagtgagaaaaaaaatcanaggcgntttgaaacaggggctctntgtgcaaggatgactaagtgtacgtctttccgtgtgtgtatgctggtgaacagtcagatttatttatatttttttgcaagcattgaataatntaagttttaaatattatttatccccatccgttngtatttatattaaagaattntgtaccctgatggttcagaagggttcttgggccttttgttcaattgtgtattggcgtacttagaattttttttatttgaaagagaaatataattcctttaaacggtaacgatgcaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattntgngaaacaaaaagaaataaagtttttnnnntgaataataaa

SEQ ID NO: 51 - DNA, 459 bp, Homo sapiens
  modified_base (446)..(448): a, c, g, t, unknown or other
  modified_base (454)..(456): a, c, g, t, unknown or other
gacaggggccaatattcaaacgctgcagcagaggcgcatagcctagccctggccaccccctcttgggaaggaggtcgagttaagccggtgtggagggtccaacaggaacggaaattacgacggtgtggttccttaaggatttggccccagtcccactaccaaatttttcccaaatcatatttaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagccttgnnnaaaaannnaaa

SEQ ID NO: 52 - DNA, 463 bp, Homo sapiens
  modified_base (454)..(456): a, c, g, t, unknown or other
  modified_base (459)..(459): a, c, g, t, unknown or other
agtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcannnaanatgc

SEQ ID NO: 53 - DNA, 865 bp, Homo sapiens
ctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcctggatgcccacccctgctgccgccactggctgtgcctcccccgccacctgtgtgttcttttgatacatttatcttctgtttttctcaaataaagttcaaagcaaccacctgtaaaaaaaaaaaaaaaaaa

SEQ ID NO: 54 - DNA, 531 bp, Homo sapiens
gggggccactgcctccagctgtgtctagtgctgcagggatctcggcatgaggccccttctcccaggaggggaggcacagcctggagacacaggccccatccttcccaatggggacacttcaggagcggctctcaggtcccgagaaagaccttcctggccacaggagacacacggacatcgggaacggacggaggaaggatgtgcagttgcagccttttcagcagacgccctgagaacgggaggtcaagagttggagcagacgggcctcagacctaaggcaggagcacccctatgccagacctcctgggtcacaggatatgccacggacattgggaagggatggaggatggacggaggaaggacgtgcagttgcagctctttctgcagatgccctgagagaggagcaagaaggtcctcgccagatgctcctggacttgctttggactttcccttgctcttggacttgctctggcacctgtgctcttggacttcacagcctctagaactgtgagaaataaatttccgttcagg

SEQ ID NO: 55 - DNA, 594 bp, Homo sapiens
ggggagcgctccctgcgagtggcgcaggtaacagaccgcaggggcaagacagccggcgcgggaggaggatggcgctgtcggtgctgcgcttggcgctgctgctcctggcagtcaccttcgcagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcatt

SEQ ID NO: 56 - DNA, 449 bp, Homo sapiens
  modified_base (43)..(43): a, c, g, t, unknown or other
  modified_base (115)..(115): a, c, g, t, unknown or other
  modified_base (395)..(395): a, c, g, t, unknown or other
  modified_base (430)..(430): a, c, g, t, unknown or other
tcgtatttttagtagagacgggtttccgcatgttggtcaggcnggtctggaactcctgacctcaagtgatccacctggctcagcttaccgaagtgctgagattccgggtgtgagnccaccgcgcctagccctctaaacttttaaataatcgtgaaatgtatgcgcagctgaagcgaattcagctatttcctctaccttttgtgtggaatttaaaatactgaacttgtgagatgaacctggtgggcaccagttctcaaacttcttggtcacaggacgcttgcactctcttaaaatgtactgaggacacctaaaagcttttgctcactgttgtttactactgctatttactaacatagaaattaaacatattaaaatattcacttaaaaaacacacngacactaacataagttatatttttattaaaaatcnttttccagacaaaaaaaaa

SEQ ID NO: 57 - DNA, 3739 bp, Homo sapiens
gcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacattttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaaaaaaaaaaaaaaaa

SEQ ID NO: 58 - DNA, 2937 bp, Homo sapiens
caatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttacgcactgtgatcaaatggtgaatatgttccaagacattctgacagaacttgccaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggtggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggattgttaagtacatacagcgatgaaattggaatgttagaggacatgcccgttggcatttccgatttaaagaaagttgcatttaaaataattgaagccaaatccaatgatgtattgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttc

SEQ ID NO: 59 - DNA, 7883 bp, Homo sapiens
ttcaagtatggcagacaaaggatgttctgcgtggggaaatgtggtgacacccatttcacaaggacagctcacatagattgagtgctcaggaaggaccagcaccatacccagtgcctgatgtgtatcatctcaattagtccttgcctcagatgcaaaaggaaaccatcgccatcatcatcaccaccatcatcatcttcctcctgtgcagatggaaaggctgaggcatagagaggtgacggagtctgcccaggactgcaagcctgctggtggcagagccaggttccaatggaatgaaggctgtcatcctcagatggcagggtaggcaggtggctagagctcacttgggagaaggggaaaggacactgactttggctagggatggagcagagcttgggctggctttccatgcacgggcagggggcgtggctcatggctacgctccagccccgggtgtggacatttaatcttccaggtctaccctaggctatgggtctggacagcactgtgatggaaagaagacactctatgtcctgcattctgtgaccaatgatgtgactgtgggaatggcgctggcatctggctgccactctgggacgggtggccagctgccatcaggccccacccaggatgggaccaccatgcgacttcttccctcgctcctcctggtcatgtccagagccccaggaggaccagcaaagcctctcgagccgatggcagctcacgttctgccttgtcagctactcctctcctgggcaatattggctgcttgctgtggctctccccggggtatgtgactgcctctgtgctgggcacctggcctgggctttccttctgggcctgggcagctgggctcagcttggacccaggcagcagccacagaggggcccatggaggtgacagagttgcttctatgatggtgaacgggcagctgtgacacggaggaggcgaccactcctgagtttccaagtgctgcggtcagggccggggccagcaaagtccctcccatattcaaagagcgggtttgggtttgtcccaggaggacatagtcaggagcccatgctgggacatgcctcctccaaagttcagcctggatccccagcctctgccaacggccccgctccttagctaacccagcttgctcctgggttccacggcggagtcagatgtttctgggcagtttcacctttgtgccttaaatgcatgttgaggactttaaggaattgtggagaaatagggctgtggcaaaggcaagtgacaactgggaacaatgatcccgcagaggctgctgaggcctgggccccaggggcgtgggttcatccttctgcctgggctttggtgggaggggcagactctgtggtctgagacacaaaaaaacccaaaacatatgtgtgtacagacacacagcagagccacacacacacttgtgcccatgcacacactcacaggaggcccgtggactccgcacagggaagaaactcctccggtcgacagtggacggcgctgcagcagggactcacccccaagccctgcctgcctcccattgcccacctggccctggcttgatgggcttatctcatgctgtggccggggacctcttgcttcctgcaaccccttgctggactggggcctgggcctctcctgggctgtgcctagggtttgtaacccagggcctgtgccggcgtgcacagagcatctctccctgggaggctcagggctgcctcctcgagctctgtgggcctgcactggccggtgagcttgtggtgtgggttttcaggctgtatccttctacctcctgagcccaggggtcccaggcgccctgcagctgtctcctcggccatcctgtggggccccgaggccttgccctcacttcagtgcctgggtgctcaggctttgcccaggtgccaggagaaggtgtgagcatgagcctattggacacacctggcgacgtataccaggtgtcccacccctgccaccatggggcctcccgatacggcaaccaccacggacctgtggggaccaatgaggaaagagagaggcaggtctgggccaggctcacagggactccggcatagcagaccctgccccagcaggcccccttgtccttcctgggtcctggtccttcatgaggaactagcccatccctggtggggctcccaccccgcttctcagtgggctctatgcttgcctcgtcggagtcacccctcaggcagtcctgggatcctctcctttagacccactgtgccttcccggcctcccgggcttctgctgggggcagaagaaatgcctccccaggtctgtctctggaggctctgagggagatgggcttgggggctgtaggaggaggcagggattccagggtgtcaggaaggcaggggtgccaggtcccacctagtgaagtaataaaccgtgggtggtgatagtgacccagtgccctcactgcccagccccgcctgtcctcagccagcactgcagggatcccaggcccagactctggaggccttcactgatcccagccaccccagaaaagctgcagcctgcaggcaccagccgggccatatgcccagtgccagctagggcccaccgcccatcctgcacacggggccgctgggcaggtgcccctcacacccccaggatgtcagtgctcacctcgagcaaagcgccccagctcggccttgggaggtggtcatgtccagggggatgatggagagctgtccaaccaagagagcgggagggagggaaggagggagggagagagatagagagagagagagagagagaggaagtgtgggccctaaggctgccttagtggaggtgcgcgtggcctgcacctcaccaagcctagccactctcgcggctctgagtggctcacaggcttgtgagggccccgtcgctgcctgctgggtccccaccagggctccctctaggaatgcgccatggctgctatgacaatttgcacagcccagtggcttaaacaccatttataccacaggtccagatgaatcctgcagggccagggtctgggggtgctggaggccatgctccctccaggcttgcggggagaacttccctgcctcctccagtctctccatccctgagctctcggctcctcctccgtcttcagggccagggcgtagcgtctgctctctcggcctctgcctccgcttcccacctcacctggcttctgtctatgtcagtctccctctgccaacctcctagaaggacacttgtgattacattagggctcacccctttaatccaggggagcctctccacttcatgattttcagctaacttgcttctgcacagaccccctttccctataagggcacacattcactggtcccggggctaaggaccttgctccaagtccctccacccatgatgctgtgccttccagaaacctgtcctctgcagctcggtcttgaccccaagcctgctggtgacctgaacttcacagggttatccccttggactgtgtgcagcacgatgcaatttctgggcctgaatgtcatgctccctggggcaggaccttgagcctgcagcacacactaggccacctgcagtctcacaggccatgccctgggtagacagggaggtgctcaaccccagctcgggtcctctagtctgcctggctaccatgcttctcactctcctgcatctgcagaccctgcgttgccatgtgaggcaggggtggggtggggctgagggcgtggctttggtccctggctgtccggatgaagtaccagagtgacgccacagcccatcccggtgacatgctcacccccaacccccgtgtccgggaccccggtcttgtgtggtccctgatgtggagtcctcagtccttaagatacatccagaaagtcctggccatgaattggaggtgcagagtcctgcagagcctctgggctgggctggtgcccccaggagatggagggcctggtggatgccctcctccctcagagctggggcagctgcctcccaggggtgggactctgggctcagagagaggcccttgagctgcagctcagggggatgcgaggcttcgtggactgtgtcctggtccatgtggtgcacgtgtctccacctccaaggagaggctcctcagtgtgcacctcccccacatccgtcctctctgccggccccgggcgtctgagcagtcattccatgccagcacctctgcagcctgctgggcctcaggttctctgtgagggacctccccggccttcggcggaggtggagtaagctccgtcaaggcaggtggcttcgtcccttcctgtgagtgacaccagtgatgaaatggacccctccacacaggcatcctcagggcacagggccctgggggcaccttcctcctttcgtatttgttgagaaaaaaagtggcattgcgctcacaccaggatgctggagcagagctgacatgctcgggaaagggcagaggtcactgggggtgggaaggtcatccagtccagactcagcacctcgtgggctggtaaactgaggctcaaagtgctggtgccaggcctgaggcctcgcggtgacccctctctctggttcccagcacctgcctgagacctgccccaggcacccataacctggaattccctgtttccttgtccagggcctgaggaaatggctccccaggtctgtctctggatgctctgaggcagatgggcttgggggctctaggaagaggcagggactccagggtgtcaggaaggcaggggtgccgggtcccacccagtggagtaacaaactgtgggtggcgtttgggcctccccgccttccccactgggtgtgctggtgctggcgctgctgggtcagggctgcccgtgaccccagacaccactgtccatcctgtgaggctcccgtctgggcatgtcctgggtggattcctcctttctgttaagtagctacatgaggcaggggctcctggatccaaagcaaatgacaggaattccagagccaggtgcatccactcagggcagccagtgttggtggagctgcctctagcacatggaggagagtgaaagtcagcctgcccctctcacgagaaaagaacctggggatacctctcagcctccagcgttgcaagtgcaaggccagtggagttaatctgcaacgtgcacgagggcgtgtgtcagtggctgtgtgcaggagtgtgagtgagcaagagcaagagcgcatggctcctgctgtacctcaaggtgtgggctcctggtggctgctcagtgttcccaggggtgagaggcctcatgtatcctaggctgcctgagatttctgtgtgctgatcgcatcctcagtttcttgtccaccgcttcactggcaagagtcccaggctccaaggacaccctccctgcacatgattgggtgttaatggtggcctgggttgtgtcttcccctggggatgagggttgggtgtccatggtgccctgggctgtgtcctcccctagggatgagggtcgggcctccacgatgccctgggctgtgtgctcttatgggaatgagggttgggtgtccaagatgccctgggctgtgtccttccctggggatgagggttggatgtccaagatgccctgggctgtgtactcccctaggaatgagggctgggtgtccaagataccctgggctgtgtcctcccctggggatgagggttgggtgtccatggtgccctgggctgtgtcctcccctggggatgacggttgggtgtccatggtgccctgggctgtgtttccttggggatgagggttgggtgctatggcatcctgggcaggtgcttcctttctgcacaagggttgggtgaccatgatgtcctggcaatggcttccctgggttgcctcttttctgccatgtgggaagagcaggggaggtttagttggtctcagcacatcattctctcaggataagtagaagagtgtctgagctgtgaggccagtgctccagctttggaattgtcttccccaccctcacctccatcccatcaaagcccgacatgtcgtgtggcagcagcgaggtgggtgttggctgttctcttgggctgggggttagtcgtggacggggaaaggagagatgctggtcaaagggcatgaagtttctgctgatgggaggagtcagttcttttgatctgttgcacagcatggtgactatagttaacaataatgactatttcaaaattgctaaaagatgagattttaaatgttctcaccacaaaatgataagtgtgtgaggtgatggatatgccacttaccttgttttaatcatcccacaatatagacaggcattgtcactttgcattgtaccccaggaatcttcacatttgcttttttgtcaattaaaaatagagacacaaaaggagagaggggagagcaatagactcttcacggaaccgtgggcttctgcctccgggtaaaataaactgcaaaaaggattcccaggaaaccgttccctctttcagcccttggttacaggaagccggatttgggaaatctgcctggatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatataggagaaaccatggtaacgtaattagaatagtcagagaaaagtagccagaaatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatacaggagaaaacacggtaacgtaattagaatagtcagagaaaagtagccagaagaatttgcaacgtgcccttgtaacaccaaatttgatcagttttttaaaaaatgatcgttatgtaggtgattgagaagtaaatgtattcttttttaaggtaaaaatttggacccttatcatgcatacccccctctgtgctcttcaaatcaacatcattattaatatctgtacatttttgctcatctgagccagcacaggctgaggctgtcagaatggacaccttttggttgttgggtttctgtcagtttctggggtgaagctgcgtgattgagaacgtagctcttggctgccatctcggggattattaaggactgtgaactctatccacaagccatggcaatatctgtcccaccgaatgctccctctaacacactcttactcccgtgatgtgtgttaagggctccgatgatgctgaaaacagcacaggatgtgaaaaggcaggaacagttctgaagtcaaaggctgatgtcctgtttctctttccctctgtgaccgactcccttcccagtggtaacaagtacccacagcttggtttgaatttctgcacgctgttgtctgtgcactcgctcacacttacgcacacagcaggcatgtgggcgatgctgggtattttgtgtatgagtgggatgcacatacacacatctacatccatatcatgcccatgcatctgtaacttgcttttcccgtgtaagaacacttcttagagtttgttcaatgcatgtgtctgtgtgaatgattgaaggcatttctaacccattttaaagatggctacttaggaccatatggatgttgtactgatgtcatttgaccacgtccattgtttccatcttttgggctgttcttgtgtattttactttccatgtaacactgtgacattgagaattggtacctacaacagtctatttgctttacattaaatttgtaggct

SEQ ID NO: 60 - DNA, 5751 bp, Homo sapiens
  modified_base (332)..(332): a, c, g, t, unknown or other
  modified_base (451)..(451): a, c, g, t, unknown or other
  modified_base (458)..(458): a, c, g, t, unknown or other
  modified_base (492)..(492): a, c, g, t, unknown or other
  modified_base (713)..(713): a, c, g, t, unknown or other
  modified_base (944)..(944): a, c, g, t, unknown or other
  modified_base (993)..(993): a, c, g, t, unknown or other
  modified_base (1091)..(1091): a, c, g, t, unknown or other
  modified_base (1097)..(1097): a, c, g, t, unknown or other
  modified_base (1100)..(1100): a, c, g, t, unknown or other
  modified_base (1104)..(1106): a, c, g, t, unknown or other
  modified_base (1108)..(1108): a, c, g, t, unknown or other
  modified_base (1183)..(1183): a, c, g, t, unknown or other
  modified_base (1222)..(1224): a, c, g, t, unknown or other
  modified_base (1227)..(1230): a, c, g, t, unknown or other
  modified_base (1232)..(1233): a, c, g, t, unknown or other
  modified_base (1235)..(1237): a, c, g, t, unknown or other
  modified_base (1239)..(1239): a, c, g, t, unknown or other
  modified_base (1264)..(1265): a, c, g, t, unknown or other
  modified_base (1438)..(1438): a, c, g, t, unknown or other
  modified_base (1976)..(1976): a, c, g, t, unknown or other
  modified_base (2025)..(2025): a, c, g, t, unknown or other
  modified_base (2040)..(2040): a, c, g, t, unknown or other
  modified_base (2588)..(2588): a, c, g, t, unknown or other
  modified_base (2692)..(2692): a, c, g, t, unknown or other
  modified_base (2902)..(2902): a, c, g, t, unknown or other
  modified_base (3503)..(3503): a, c, g, t, unknown or other
  modified_base (3505)..(3509): a, c, g, t, unknown or other
  modified_base (4187)..(4187): a, c, g, t, unknown or other
  modified_base (4194)..(4194): a, c, g, t, unknown or other
  modified_base (4681)..(4681): a, c, g, t, unknown or other
  modified_base (4710)..(4710): a, c, g, t, unknown or other
  modified_base (4744)..(4744): a, c, g, t, unknown or other
  modified_base (4777)..(4777): a, c, g, t, unknown or other
  modified_base (5195)..(5195): a, c, g, t, unknown or other
caaggtagcaggagatgaacgcgtgctgctccaggattttacagaactgattctgcagcaaagacaaatgtgcctgtattgccagatagtataaacaggagcaaaagtgcacagctaaaccaggggctcattcccaggacagacatgcagttatggattccgaaagacaagtcaaggttaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctcntcggcagacgccttcaccagatgtagtcctcaggggaagcagcgatgggagaggaagcgactctgaatccgacttgcctcatcggaagctgccagatgtgaagaaggatgacatgtctngcacggnggacttcccatggtgagccgaaatcagcagtgcnttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcgntgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattnttcaagaaaaagagcggagagagagagagctgcatgaagcatataagancgctcggtcccaggaggaggcagaggggatccttcaacagtacattgagaggttcaccatcagtgaggctgttctcgaacgcttggagatgccaaaanttctgnaangaannnantcaacagagccaaatttatcctccttcctgaatgaccccaatcccatgaaatacctgcggcaacagtcactgccnccacccaaattcactgccactgttgaaaccaccattgcnnntgnnnntnntnnngnataccagcatgtcagcaggcagtgnntctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggntggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttangacaccttttaagttctgggcatgggacccagaagaggagcgcaggcgncaggaaaaatggcancaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggnataaaagcattaaccatcagatcgagtctcccagtgaaaggcggaagtctataagtggaaagaagctgtgctcttcctgtgggcttcctttgggtaaaggagcngcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcacncatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattanannnnntgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggtttttngtttttngttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaanaaaaaaagaaaaaattaaaaagaaaaatngttttgaaaatgtacagatcaagtccaatatttngattatccacctgcatgttttattaaatatttngataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgtnttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaaaaaaaaaaac

SEQ ID NO: 61 - DNA, 1647 bp, Homo sapiens
gcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttttcgcgctccgatcacctggcgctgcacatgaaacggcacatgtagccgggacgcccccgcccacctgcggcgggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatctttt

SEQ ID NO: 62 - DNA, 2335 bp, Homo sapiens
  modified_base (292)..(292): a, c, g, t, unknown or other
  modified_base (436)..(436): a, c, g, t, unknown or other
  modified_base (458)..(458): a, c, g, t, unknown or other
  modified_base (470)..(470): a, c, g, t, unknown or other
  modified_base (515)..(515): a, c, g, t, unknown or other
  modified_base (524)..(524): a, c, g, t, unknown or other
  modified_base (526)..(526): a, c, g, t, unknown or other
  modified_base (528)..(532): a, c, g, t, unknown or other
  modified_base (566)..(567): a, c, g, t, unknown or other
  modified_base (572)..(573): a, c, g, t, unknown or other
  modified_base (581)..(581): a, c, g, t, unknown or other
  modified_base (592)..(594): a, c, g, t, unknown or other
  modified_base (596)..(596): a, c, g, t, unknown or other
  modified_base (600)..(600): a, c, g, t, unknown or other
  modified_base (627)..(627): a, c, g, t, unknown or other
  modified_base (635)..(635): a, c, g, t, unknown or other
  modified_base (645)..(646): a, c, g, t, unknown or other
  modified_base (649)..(649): a, c, g, t, unknown or other
  modified_base (657)..(657): a, c, g, t, unknown or other
  modified_base (660)..(660): a, c, g, t, unknown or other
  modified_base (676)..(676): a, c, g, t, unknown or other
  modified_base (685)..(689): a, c, g, t, unknown or other
  modified_base (704)..(704): a, c, g, t, unknown or other
  modified_base (712)..(712): a, c, g, t, unknown or other
  modified_base (715)..(715): a, c, g, t, unknown or other
  modified_base (721)..(721): a, c, g, t, unknown or other
  modified_base (725)..(725): a, c, g, t, unknown or other
  modified_base (727)..(727): a, c, g, t, unknown or other
  modified_base (730)..(730): a, c, g, t, unknown or other
  modified_base (742)..(742): a, c, g, t, unknown or other
  modified_base (752)..(752): a, c, g, t, unknown or other
  modified_base (760)..(760): a, c, g, t, unknown or other
  modified_base (764)..(764): a, c, g, t, unknown or other
  modified_base (766)..(766): a, c, g, t, unknown or other
  modified_base (770)..(770): a, c, g, t, unknown or other
  modified_base (772)..(772): a, c, g, t, unknown or other
  modified_base (774)..(774): a, c, g, t, unknown or other
  modified_base (778)..(778): a, c, g, t, unknown or other
  modified_base (781)..(781): a, c, g, t, unknown or other
  modified_base (788)..(788): a, c, g, t, unknown or other
  modified_base (800)..(800): a, c, g, t, unknown or other
  modified_base (803)..(803): a, c, g, t, unknown or other
  modified_base (805)..(805): a, c, g, t, unknown or other
  modified_base (812)..(812): a, c, g, t, unknown or other
  modified_base (841)..(841): a, c, g, t, unknown or other
  modified_base (848)..(848): a, c, g, t, unknown or other
  modified_base (858)..(858): a, c, g, t, unknown or other
  modified_base (865)..(865): a, c, g, t, unknown or other
  modified_base (871)..(871): a, c, g, t, unknown or other
  modified_base (877)..(877): a, c, g, t, unknown or other
  modified_base (882)..(882): a, c, g, t, unknown or other
  modified_base (948)..(948): a, c, g, t, unknown or other
  modified_base (966)..(967): a, c, g, t, unknown or other
  modified_base (984)..(984): a, c, g, t, unknown or other
  modified_base (1002)..(1002): a, c, g, t, unknown or other
  modified_base (1008)..(1008): a, c, g, t, unknown or other
  modified_base (1019)..(1019): a, c, g, t, unknown or other
  modified_base (1175)..(1181): a, c, g, t, unknown or other
  modified_base (1183)..(1183): a, c, g, t, unknown or other
  modified_base (1201)..(1201): a, c, g, t, unknown or other
  modified_base (1398)..(1398): a, c, g, t, unknown or other
  modified_base (1446)..(1446): a, c, g, t, unknown or other
  modified_base (1547)..(1547): a, c, g, t, unknown or other
  modified_base (1577)..(1577): a, c, g, t, unknown or other
  modified_base (1579)..(1579): a, c, g, t, unknown or other
  modified_base (1684)..(1684): a, c, g, t, unknown or other
ggagatagcagcgctggcgccctgggttcccgggtgcttcctgcctgaccagtccccatgtctgggcggtgcagtcgcgcgtggcccgccagcacgtcagtatgtcgggtggcaacaggggaccaccactgacaggtctctcccgccctgtccccgcagcgctggcgggaggagctctcccacatgaagcgacttcccccagtgcttcccggccgcccctatgacctggcggcggcgaccgtggccacagacctggagagcggcggagccggtgcggcttgcggcggtagcnacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgncgccgtcgagcagcggccctgncagcgcgccctncacctgcagcttcacctatccgatccgggccgggaacgacccggncgtggcgcngngnnnnncgggcggaggcctcctctatggcagggagtccgnnccccnnccgacggntcccttcaacnnngngganatcaacgacgtgagcccctcgggcggnttcgtggncgagctcctnnggncagaattnganccggtgtacattccgncgcagcagnnnnncgcagccgccaggtngcgggctnatnggcaanttcntnctnaaggcgtcgctnagcgcccctngcagcgantacngnagcncntnggtnatnagcgtcngcaaaggcagcnctnanggcagcnacccggtggtggtggcgccctacaacggngggccgncgcgcacgtnccccaanatcaancaggangcggnctcttcgtgcacccacttgggcgctggaccccctctcagcaatggccaccggcggctgcacacganttccccctggggcggcanntccccagcaggactacnccgaccctgggtcttgangaagtnctgagcagcanggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccannnnnnngnggggaagacgatcgtggncccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgnccgttccagtgccaaaaatgcgaccgagcattttccaggtcggaccanctcgccttacacatgaagaggcatttttaaatcccagacagtggatatgacccacactgccagaagagaattcagtattttttacttttcacactgtcttnccgatgagggaaggagcccagccagaaagnantacaatcatggtcaagttcccaactgagtcatcttgtgagtggataatcaggaaaaatgaggaatccaaaagacaaatccgacttgaatattcctggacttacanaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaa

SEQ ID NO: 63 - DNA, 1097 bp, Homo sapiens
tgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaaaa

SEQ ID NO: 64 - DNA, 1277 bp, Homo sapiens
gcgcatgtgcaaggtgtccaaactgacaatgctggagagatagcgagtgtggattgagagaaagggagagagggagggagagagagtgaaagaagaaaatacagagagtgagtgtgtggaagagagagagaaacaggagagaaacaggagggggggagagagagagagagagagagagagagagagagagagagagagagagagacaggagagagagggagggagcgagagggagagcaaaagaaggaaaggatccaagaaaaaaaagccccaaccacacaccagaggctgcaggactgggcacagcatgagatccaaaggcagggcaaggaaactggccacaaataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggaggtacatcttccaaggtctcggagggtaagcgttcactcttggttgtatttggggaagagaagctcagacgtaggaatagccttctctcaggctgatgtctacatgcctggactgcagtgtgccttcctctcgtagctcggaaggacgcggaacctgggtggctggagccgcccgctgcgctttatttcggagcgcaatgccatctaccggcgtcctgccgtacctgcaagtatccagaccttgaaagtcgctccgcctccccccacccgaagccaatataggggaaaaaactcggaggccctttccacgaaatcctaatttagccaggacctgccaatgattccagacgaccttttgttttcctaccgacgtttcctcgttttgaaagcagttttgtaaagggcaaggaggtgggggccgcagggttggggcgctgagctcccagaccccctgatcaggcgcactgtctgaagcaatcggttccccagattacttgatatttaatacacaatgcatcataaaacaaatccctcatcctgacaggaagaaaatagaacagctcatagctcgagccagtccaatttatggctaaatt

SEQ ID NO: 65 - DNA, 3377 bp, Homo sapiens
  modified_base (212)..(212): a, c, g, t, unknown or other
  modified_base (1953)..(1953): a, c, g, t, unknown or other
  modified_base (2720)..(2723): a, c, g, t, unknown or other
  modified_base (2725)..(2725): a, c, g, t, unknown or other
  modified_base (2733)..(2739): a, c, g, t, unknown or other
  modified_base (3063)..(3063): a, c, g, t, unknown or other
ttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtnccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggntttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaannnnanctgtaaannnnnnnaatccagcattgttgagctgtcatcaacattcttgtgtctgttttactgttacaatattaggtgaatatggaagtaaaggcattccacaggatcatcatttaaaaaaaaagaattctggtcctgttttctaaaaaaaaaaaactgttgtagaaattcttaatttggatctatttattagtcagagtttcagctttcttcagctgccagtgtgttactcatctttatcctaaaaatctggaatcagagatttttgtttgttcacatatgattctcttagacacttttatatttgaaaaaattaaaatctttctttggggaaaaantcttggttattctgccataacagattatgtattaacttgtagattcagtggttcaatacctgtttagttgcttgctaatatttccagaaggatttcttgtattggtgaaagacggttggggatggggggatttttttgttcttgttgtacccttgttttgaaactagaaatctgtcctgtggcatgcaaaagaaagcaaattatttttaaaagaaaaaaaccaaagtacttttggtgtcattattccatcttctccataagtggagaaatgaaaagtaagaacagctcatcttcaaagtttttactagaaattc

SEQ ID NO: 66 - DNA, 3646 bp, Homo sapiens
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggagactgaggcatgccctgtggccctcacttccagacctgcaccgggtcctaggccagtaccttagggacactgcagccctgagcccgcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttgaggacaggctcctcactcccagttccctggacagagctaaactctcgagacttctctgtgaacttccctaccctacccccacaacacaagcaccccagacctcacctccatccccctctgtctgccctcacaattaggcttcattgcactgatcttactctactgctgctgacataaaaccaggaccctttctccacaggcaggctcatttcactaagctcctcctttacttcctctctcctctttgatgtcaaacgccttgaaaacaagcctccacttccccacacttcccatttactcttgagactacttcaattagttcccctactacactttgctagtgaactgcccaggcaaagtgcacctcaaatcttctaattccaagatccaataggatctcgttaatcatcagttcctttgatctcgctgtaagatttgtcaaggctgactactcacttctcctttaaattctttcctaccttggtcctgcctctttgagtatattagtaggttttttttatttgtttgagacagggtctcactctgtcacccaggctgcagtgcaatggcgcgatctcagctcactgcaacctccacctccgggttcaagcgattcttgtgcctcggcctccctagtagctgggattacaggcgcacaccaccacacacagctaatttttttttttttttttttttttttttttttttttagacggagccttgcctgttgccagactggagtgcagtggcacgatctcggctcactgcaacctctgcctcccgggttcaagccattctgcctcagcctcccaagtagctgggagtacagcgtctgccaccatgcctaatttttttctatttttaggagagaccggttttcaccacgttggccaggatggtctcgatatctgatctcgtgatccgcctgcctctgcctcccaaagtgctgggattacaggtgtgacccactgcgcacagccccagctaattttcatatttttagtagagacagggttttgccatgttgcccaggctggtcttgaactcctaacctcgggtgatccacccaccttggcctcccaaagtgttaggattacaggcatgagccactgcgcccggctgagtgtactagtagttaagagaataaactagatctagaatcagagctggattcaattcctgtccttcacatttactagctgtgcaaccttgggcacataacttaatgtctttgagccttagttttttcatctgtaaaacagggataataacagcaccccatagagttgtgacgaggattgagataatctaagtaaagcacagtccctaggacatagtaaatgattcatatatccgaactactgttataattattccttcttactctcctcttctagcatttcttccaattattacagtccttcaagattccatttcttaacagtctccaatcccatctattctctgcctttactatatgttgaccattccaaagttcttatctctagctcagacatctactacagcactgtgatgctttatgcaactaactgtttacatatctgtcccctgctactagattgtgagctccttgagggaaaggaacatgatttatttgtccttttcccccagcacctagagtagtgcttggtgcatgatagtaggccttcaataaattttttctaaatgaatga

SEQ ID NO: 67 - DNA, 2968 bp, Homo sapiens
  modified_base (2795)..(2796): a, c, g, t, unknown or other
  modified_base (2798)..(2799): a, c, g, t, unknown or other
gcatggtcgactacacgcccaaataagaagccacctctaagcaaaatagctatatgtataaacggagggcgaatatatacaagtatatatatatgtatattacagacgcacaggtttacacccggtgaactttttctttttctttttctttttcctttttttttaagaaaaactagtgacattggagagaaggacgcttcctctctatcttttggcgcattagtgaagggggtattctattttgttaaagcgcccaaggggaccgggaaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctggaggacaggtttgtggttgaggacttctctgtccgatgtctacattcaggttctgacttcatatcttgaaaaaggatttcctccctgtctttttcagtgtctcataaacgctactctggattgttgtaaatattagtgagatgggaggatttacagaagaaaagcaagtcaaaaatatttcctttttgatgtaaaaaaaaaaagccctatttcgcactaacattttattttacaagtattttaatcttatattttggtattagaaaaatttgtctattttttcattttgaagattaaatgttgcttacattttaaaannannggtgaagtgtacaacaaaccaataatgataaaaaatacttctctttttctccctgtttccctttttcccttggccacagccaaatgctaattgctgctttaattacagagatgtgtaaatgtattcagattacaaactctacaggaatacatcaacaccttaactctaa

SEQ ID NO: 68 - DNA, 7584 bp, Homo sapiens
  modified_base (313)..(313): a, c, g, t, unknown or other
  modified_base (824)..(824): a, c, g, t, unknown or other
  modified_base (1941)..(1941): a, c, g, t, unknown or other
  modified_base (4310)..(4310): a, c, g, t, unknown or other
  modified_base (4609)..(4609): a, c, g, t, unknown or other
  modified_base (4619)..(4619): a, c, g, t, unknown or other
  modified_base (4682)..(4682): a, c, g, t, unknown or other
  modified_base (4832)..(4832): a, c, g, t, unknown or other
  modified_base (5293)..(5293): a, c, g, t, unknown or other
  modified_base (5309)..(5309): a, c, g, t, unknown or other
  modified_base (5600)..(5600): a, c, g, t, unknown or other
  modified_base (5846)..(5847): a, c, g, t, unknown or other
  modified_base (6154)..(6154): a, c, g, t, unknown or other
  modified_base (6345)..(6345): a, c, g, t, unknown or other
  modified_base (6461)..(6461): a, c, g, t, unknown or other
  modified_base (6775)..(6782): a, c, g, t, unknown or other
  modified_base (7560)..(7564): a, c, g, t, unknown or other
cgacccggcccacgcccgccgcacccgcgcgcgcccgtcgcccgtggcctcgcgtcgacgctgcgccgtgagcgccgctggtcggagggaagagctcgccggggcgccgggccaggacggggcggcaggcgccttcgcggaccgagcctgacggagccggaggctgggagccgcggcggcctggggaagtgtttggattgtgagctatttcagaactgttctcaggactcattattttaacatttgggagaaacacagccagaagaacactgatatttgcatttaatggggaacaaaagatgaagaaggaaanggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcagggntctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacacngaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcntcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaanaaaaaaaaanggtgtttatttttaactcttggaagaggttttgtggttcccaatgtgtctgtcccaccctganccttttcaatatatatttctttaaaccttgtgctacttagtaaaaattgattacaattgagggaagtttgatagatcctttaaaaaaaaggcagatttccattttttgtattttaactactttactaaattaatactcctccttttacanaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttnatatattaccgttatntctttggaaatccgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaaggncactaaactcagattgactaaataaaaagtacaaagggcacatatacgtgacagaattggtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgnnccaggttagcaaatgacctatcaaaaattattctataatcactactagttaggatattgatttaaaattgttctacttgaagtggtttctaagatttttatatttaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactntgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagatgaaatttaggtcagggaaaagaccaagggccagcatngctacttttgtgtgtgtgtgtgtgggttttgttttgttttttttggttggctggttgttttcgttgttgttaacaaaggaatgagaatatgtaatacttaaataaacatgaccacnaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatannnnnnnnatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtggcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcannnnnaaaaaaaaaaaaaaaaaaaa

SEQ ID NO: 69 - DNA, 3089 bp, Homo sapiens
aaagattccgaggtgcagaagttgtctgagtgggttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttcccaggtgaagtgcttatggcttaaggaactcttggccattcaaaggacttttcattttgattaacaggactagcttatcatgagagcctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagtacagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataat

SEQ ID NO: 70 - DNA, 5134 bp, Homo sapiens
ggacacggagccgcgaggagacagctgaggcccgcggagaccagggggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtgttgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaagtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggtttgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctcaggacaggatgactgtcttccctattcttagggacaagtcccaagatgccagaaaggcagtctcccaaggacccaccatgcagaagtgtcaataaaccacaagttctg

SEQ ID NO: 71 - DNA, 1032 bp, Homo sapiens
gaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatcaaagatgaccttataatatgtacccgaatatacagttcaagaattttgtctgactggaaataaatgcattttgtagcaaaaaaaaaaaaaaaaa

SEQ ID NO: 72 - DNA, 6568 bp, Homo sapiens
cttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttacacgggtagtattattgtgggtaaataatcacttcaatgactttgaaggagatcctgcaatgactcgatttttagaagaatttgaaaacaatctggaaagagagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaatgatattgggattggtcagtctcaagatgacagcatagtaggattaaggcagacaaagcacatcccaactgcattgcctgtcagtggaaccttatcatccagtaatcctgatttattgcagtcacatcatcgcattttagacttcagtgctactcctgacttgccagatcaagtgctaagggtttttaaggctgatcagcaaagccgctacatcatgatcagtaaggacactacagcaaaggaagtggtcattcaggctatcagggagtttgctgttactgccaccccggatcaatattcactatgtgaggtctctgtcacacctgagggagtaatcaaacaaagaagacttccagatcagctttccaaacttgcagacagaatacaactgagtggaaggtattatctgaaaaacaacatggaaacagaaactctttgttcagatgaagatgctcaggagttgttgagagagagtcaaatttccctccttcagctcagcactgtggaagttgcaacacagctctctatgcgaaattttgaactctttcgcaacattgaacctactgaatatatagatgatttatttaaactcagatcaaaaaccagctgtgccaacctgaagagatttgaagaagtcattaaccaggaaacattttgggtagcatctgaaattctcagagaaacaaaccagctgaagaggatgaagatcattaagcatttcatcaagatagcactgcactgtagggaatgcaagaattttaactcaatgtttgcaatcatcagtggcctaaacctggcaccagtggcaagactgcgaacgacctgggagaaacttcccaataaatacgaaaaactatttcaagatctccaagacctgtttgatccttccagaaacatggcaaaatatcgtaatgttctcaatagtcaaaatctacaacctcccataatccctctattcccagttatcaaaaaggatctcaccttccttcacgaaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccttatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacat

SEQ ID NO: 73 - DNA, 1326 bp, Homo sapiens
atcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggttccccgctgccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcaccaaaactatttcttggcgacctttgagagatttcaataaaaattttaatcagagccaaaatggactcc

SEQ ID NO: 74 - DNA, 2091 bp, Homo sapiens
  modified_base (6)..(6): a, c, g, t, unknown or other
  modified_base (90)..(90): a, c, g, t, unknown or other
  modified_base (108)..(108): a, c, g, t, unknown or other
  modified_base (111)..(113): a, c, g, t, unknown or other
  modified_base (115)..(115): a, c, g, t, unknown or other
  modified_base (117)..(119): a, c, g, t, unknown or other
  modified_base (137)..(137): a, c, g, t, unknown or other
  modified_base (170)..(170): a, c, g, t, unknown or other
  modified_base (582)..(582): a, c, g, t, unknown or other
  modified_base (605)..(605): a, c, g, t, unknown or other
  modified_base (634)..(634): a, c, g, t, unknown or other
  modified_base (836)..(836): a, c, g, t, unknown or other
  modified_base (981)..(981): a, c, g, t, unknown or other
  modified_base (1372)..(1372): a, c, g, t, unknown or other
  modified_base (1863)..(1863): a, c, g, t, unknown or other
  modified_base (1872)..(1877): a, c, g, t, unknown or other
  modified_base (1879)..(1879): a, c, g, t, unknown or other
  modified_base (1881)..(1882): a, c, g, t, unknown or other
  modified_base (1884)..(1888): a, c, g, t, unknown or other
  modified_base (1929)..(1929): a, c, g, t, unknown or other
  modified_base (1951)..(1951): a, c, g, t, unknown or other
tggccnagctctcaagccccctgttccaagctcagacagcctctgaagccgcaggggactctcttctccccgcttgtctctggcccctgnagaggcttggaaggccanaannnangnnngagctgcagcatgccaanagttccccactgctccggggcagccactccttngagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaantcagtgagggtgaggagactccnaggaacagcgtctctcccatgccaagggntccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgcnagagccagccttgtcagctcctccgatggctccttcctcgctgatgctcactttgcccgggccctggcagtggctgtggatagctttggtttcggtctagagcccagggaggcagactgcgtcttcatagatgcctcatcacctncctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattngagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaanacttgaaannnnnnanannannnnncggagcaccatttttaggggagcacctggagagatggcaanaatttcctgagttaggcagggntcaggcattcattgacactcagggagtgtcacacatttctgttctgcaattaaagggagaatgaggttcatccaccaaattttaagcagaatataggaagggcaggggtggggagtttcagggtctgctggtcctgggca

SEQ ID NO: 75 - DNA, 830 bp, Homo sapiens
  modified_base (239)..(239): a, c, g, t, unknown or other
  modified_base (253)..(253): a, c, g, t, unknown or other
  modified_base (260)..(260): a, c, g, t, unknown or other
  modified_base (263)..(263): a, c, g, t, unknown or other
  modified_base (265)..(265): a, c, g, t, unknown or other
  modified_base (274)..(275): a, c, g, t, unknown or other
  modified_base (278)..(278): a, c, g, t, unknown or other
  modified_base (288)..(288): a, c, g, t, unknown or other
  modified_base (291)..(291): a, c, g, t, unknown or other
  modified_base (297)..(297): a, c, g, t, unknown or other
  modified_base (431)..(433): a, c, g, t, unknown or other
  modified_base (436)..(436): a, c, g, t, unknown or other
  modified_base (440)..(441): a, c, g, t, unknown or other
  modified_base (444)..(445): a, c, g, t, unknown or other
  modified_base (448)..(451): a, c, g, t, unknown or other
  modified_base (495)..(495): a, c, g, t, unknown or other
  modified_base (529)..(529): a, c, g, t, unknown or other
  modified_base (540)..(540): a, c, g, t, unknown or other
  modified_base (546)..(546): a, c, g, t, unknown or other
  modified_base (664)..(664): a, c, g, t, unknown or other
  modified_base (754)..(756): a, c, g, t, unknown or other
  modified_base (758)..(759): a, c, g, t, unknown or other
  modified_base (761)..(761): a, c, g, t, unknown or other
  modified_base (766)..(766): a, c, g, t, unknown or other
taaaaaaaggtttctgcatcgtggaagcatttgacccagagtggaacgcgtgccccatcaatcctattaatcctcagaattcctttggttctttgagcatctttgctttcattcgtctcccgtctttggttctccagttcaaattattgcaaagtaaaggatctttcgagtaggttcggtctgaaaggtgtgggcctttatatttgatccacacacgttggtcttttaaccgtgctgancagaaaacaaaacnggttaanaananccgggtggnnagntgacagaggnaanccgctnaaataccttcacaataaatagtggcaatatatatatagtttaagaaggctccccatttggcatcgtttaatttaaatgttatgttataagcacagctctcttctccaattttcatcctgcaagcaactcaaaannnttnaaannaannttnnnntgtagttattttcaaatctttgcttgataagtattaagaaatantggacttgctgccgtaatttaaagctctgttgantttgtttccgnttgganttttgggggaggggagcactgtgtttatgctggaatatgaagtctgagaccttccggtgctgggaacacacaagagttgttgaaagttgacaagcagactgcgcatgtctctgatgcnttgtatcattcttgagcaatcgctcggtccgtggacaataaacagtattatcaaagagaaaaaaaaaaaaaaaaaaaaaaaaaaaaaaannngnngncgcgngccgcgaatttagtagtagtagtcgacccgggaattccggaccggtacctgcaggcgtaccagc

SEQ ID NO: 76 - DNA, 3869 bp, Homo sapiens
  modified_base (889)..(890): a, c, g, t, unknown or other
  modified_base (896)..(896): a, c, g, t, unknown or other
  modified_base (970)..(973): a, c, g, t, unknown or other
  modified_base (1415)..(1415): a, c, g, t, unknown or other
  modified_base (1417)..(1417): a, c, g, t, unknown or other
  modified_base (2174)..(2174): a, c, g, t, unknown or other
  modified_base (2270)..(2270): a, c, g, t, unknown or other
  modified_base (2272)..(2272): a, c, g, t, unknown or other
  modified_base (2322)..(2322): a, c, g, t, unknown or other
  modified_base (2675)..(2676): a, c, g, t, unknown or other
  modified_base (2702)..(2702): a, c, g, t, unknown or other
  modified_base (2780)..(2780): a, c, g, t, unknown or other
  modified_base (3238)..(3238): a, c, g, t, unknown or other
  modified_base (3278)..(3278): a, c, g, t, unknown or other
  modified_base (3302)..(3302): a, c, g, t, unknown or other
  modified_base (3347)..(3347): a, c, g, t, unknown or other
  modified_base (3366)..(3366): a, c, g, t, unknown or other
  modified_base (3380)..(3380): a, c, g, t, unknown or other
  modified_base (3409)..(3410): a, c, g, t, unknown or other
  modified_base (3687)..(3687): a, c, g, t, unknown or other
  modified_base (3696)..(3701): a, c, g, t, unknown or other
  modified_base (3703)..(3703): a, c, g, t, unknown or other
cctggtttctctacatactaaccccatgtctctctggactcacacctggctcaggccttccagaccaaactcatacttcctcctcaccagaagtttccgaatctcacactagagaagatttgtcacctttaaagtccactcacattattttgactcagggttttgttttttgtctatttcccctcctgcaactctcctttaaaagtgaaaagagagagaatggtttaagtagtctgttgctcataagcacgtgtctgcagtctgtcacttgcaaggccttggtgatcaccatgcagcacttgtgcgcacacacacccccacaagtcttttttcctaataatccattttccacattgccatgagggtaaagggttccaatcaaaaccaccattaaactgcatagtttctagtcttccctcagccctgatgctaattatgatagtttgcatagacataacttaaacttgtgattctccctccttccagagctttttgtagccctttttccccccaaaattagttttgttcaaaatcaagcattgggcccagccattaagataagacctaataagtgagagatacagttcccaagagtttacagatccaggtgttcacatggtggtggccagtctaccgtttatcttgtcaaggttgttactgctaatttggtgtcactttggtcttgggcagcggtggtgggcgacgtatctaatgagcgtgccattgacttctccatgtttgtctgtgtacgaggggtgcaggttgtctgtaatccactaaagtgtcagccacacccagctttagtaactcgctaatcgcacaccctgggtatatcagccaggggctgctacagttaatggtacacagttgatggtacacaggctgaaanngataangaatcaagaccctactacatttccaaagccgaaaagccatgagggttacaatttaaatgagcttgggaaggaannnncccgaagacgtctccagcctgaagggtcagagccgctggaagcctggctgtctctgggctttctcgtctcagtgcagcaaggcaccgtgatcaaccaacccgtgatggggaaggccctggttctgtctttgtttgggggtaaatagctgtgtggtgttgagtgactgtgattggcttttccagctcctttaacacaaactacaacccactcacgatacaacttcggcagatgtggtcaaattgatgtttgttgacttgcctcatttccttccagctcttaagttccaaagtctaactgggatggtagatgtgaaatgcatgattgtcgtcctaatttctgcatgtgtttatgacaatgtgttgaggggagggggaggagagccagagagcattttcaggaaccgaggtctttccttgtcttactctgggggaatgccatgtngnctctgatagagttgtctatcggtctgtttgtgaatgccctttcgcttaaacttccagcccttctggtggcatccttggttgtaaggtggctgctgtataacgtccactctctttcatatttaatatgtgtgattgttactgttgtctttttgttttaaagtaaccataagaggagatgatctgagttatatttattgatcagaggaatagagtgcagtaaaactcatactggcatttcgcttttctcatttccctgtaaatgggcgggtattaatccattcccaccttctaatgtccttgatgtccagctggctttgtgggtgtgcaatggttttactgtactgcctcgatctgtgccaggcatttatacacagccacatgtgcgagtcaggtagagcgtatgtggtcacccccatggctcacggagttagctgaatggcctctccgctgtccctagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcnaagactgctgcttctggaattccctaccacagcgaggtccctgtgagtttgaaagaagctgtctgcgaagtggcccttgattacaaaaagaagaancncgtattcaagctaagactaaatgatggcaatgagtacctcttccaagccnaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgattttttttttttttnnaatttatagagcatttcggggggggntgggggaaacacacctaaacactttatctccaagttacaaaagtttgaggtgcagagggaaggccagatttttttttnaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaatttttttttttttttngctgaaatacattatattgtacgtttgagataattctagntacaaagtataataaaactagatngtataataaaccctttaaatcattggtaagtgtacaagtggtggnaactgaagcatttactggnacaaagtaatgttnactctaatggttacttgctcgtgcgttgnnccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctaaaaaaaaaaaaaaaaaaanaaaaaaaannnnnngngtgtgcatgcccagtagggaaactgcaaagggagaaatgacaaacaagaaacattttacaaccagtctgggctcacttttgcattttttatgcatgtctggtgcacaagctttgaaaactacagcaaacagtaataaatgtgactgttttgtagttataaaaaaaa

SEQ ID NO: 77 - DNA, 1140 bp, Homo sapiens
ggcacgagcagcgactttaggctggataatagtcaaattcttacctcgctctttcactgctagtaagatcagattgcgtttctttcagttactcttcaatcgccagtttctggatctgcttctaaaagaagaagtagagaagataaatcctgtcttcaatacctggaaggaaaaacaaaataacctcaactccgtttcgaaaaaacattccaagaactttcatcagagattttacttgaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttccaagcctttttgttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgtagcatactgctaataaagttttaatatttacatgcatagtaaaaaaaaaaaaaaaaaaaa

SEQ ID NO: 78 - DNA, 1769 bp, Homo sapiens
cctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagaaaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttcaaaaaaaaaaaaaaaaaaaaacttcagtaagtacgtgttatttttttcaataaaattctattacagtatgtcaaaaaaaaaaaaaaaaaa

SEQ ID NO: 79 - DNA, 1008 bp, Homo sapiens
  modified_base (3)..(3): a, c, g, t, unknown or other
  modified_base (263)..(267): a, c, g, t, unknown or other
  modified_base (283)..(283): a, c, g, t, unknown or other
  modified_base (289)..(289): a, c, g, t, unknown or other
  modified_base (293)..(295): a, c, g, t, unknown or other
  modified_base (310)..(310): a, c, g, t, unknown or other
  modified_base (316)..(316): a, c, g, t, unknown or other
  modified_base (319)..(319): a, c, g, t, unknown or other
  modified_base (334)..(334): a, c, g, t, unknown or other
  modified_base (393)..(393): a, c, g, t, unknown or other
  modified_base (410)..(412): a, c, g, t, unknown or other
  modified_base (414)..(420): a, c, g, t, unknown or other
  modified_base (422)..(426): a, c, g, t, unknown or other
  modified_base (513)..(513): a, c, g, t, unknown or other
ttntcctaaataaactaaagtctaggcaagtggctgagctaggtttgccatgaatcaatctgctgagtatatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttnnnnnagctacctcttgtgtnttaagnattnnnagggaagatgagctnaggaantcnaagaaatacgcaganactgattcctgtcactggcgccaccctgccacttgcccagagctgtggtataaattttnttaataggctgaaatannnannnnnnntnnnnnttttggtattaagcattaaattgataaaggctatgagatacacctgctctcaaccatgttaattttttattattggtattaataaanttattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcaaaaaa

SEQ ID NO: 80 - DNA, 4251 bp, Homo sapiens
  modified_base (760)..(762): a, c, g, t, unknown or other
  modified_base (764)..(766): a, c, g, t, unknown or other
  modified_base (771)..(772): a, c, g, t, unknown or other
  modified_base (1074)..(1075): a, c, g, t, unknown or other
  modified_base (1077)..(1079): a, c, g, t, unknown or other
  modified_base (1081)..(1086): a, c, g, t, unknown or other
  modified_base (1353)..(1353): a, c, g, t, unknown or other
  modified_base (1358)..(1358): a, c, g, t, unknown or other
  modified_base (1382)..(1382): a, c, g, t, unknown or other
  modified_base (1448)..(1450): a, c, g, t, unknown or other
  modified_base (1452)..(1452): a, c, g, t, unknown or other
  modified_base (1668)..(1672): a, c, g, t, unknown or other
  modified_base (1674)..(1674): a, c, g, t, unknown or other
  modified_base (1676)..(1679): a, c, g, t, unknown or other
  modified_base (1681)..(1688): a, c, g, t, unknown or other
  modified_base (1882)..(1882): a, c, g, t, unknown or other
  modified_base (1917)..(1917): a, c, g, t, unknown or other
  modified_base (2100)..(2100): a, c, g, t, unknown or other
  modified_base (2501)..(2501): a, c, g, t, unknown or other
  modified_base (2507)..(2507): a, c, g, t, unknown or other
  modified_base (2515)..(2515): a, c, g, t, unknown or other
  modified_base (2598)..(2598): a, c, g, t, unknown or other
  modified_base (2634)..(2634): a, c, g, t, unknown or other
  modified_base (2771)..(2771): a, c, g, t, unknown or other
  modified_base (2800)..(2800): a, c, g, t, unknown or other
  modified_base (3375)..(3375): a, c, g, t, unknown or other
  modified_base (3471)..(3471): a, c, g, t, unknown or other
  modified_base (3651)..(3652): a, c, g, t, unknown or other
  modified_base (3850)..(3850): a, c, g, t, unknown or other
attttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcnnnannngatanngcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtnngnnnannnnnnagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgtnagctngcagaaaatgacccttatggaccnttgccaccaggctgggaaaaaagagtggattcaacagacagggtttactttgtgaatcataacacnnnanacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgcnnnnntncnnnntnnnnnnnngtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttntgaacccaatgtattgcttatttgagtatgcgggncaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggattnggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcattnggtttnggcagttngtgaaagagacagacaatgaagtaagaatgcgactattgcagttcgtcactggaacctgccgtttacctctaggaggatttgnctgagctcatgggaagtaatgggcctcaaaagtttngcattgaaaaagttggcaaagacacttggttaccaagaagccatacatgttttaatcgcttggatctaccaccatataagagttatgaacaactaaaggaaaaacttctttttgcaatagaagagacagagggattnggacaagaatgaatgtggcttcttatttnggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaattttnctctgttacatcagtaatattgttaaagtaatggatagaaccataacttacacatgaaagtcatatactagatccaatactatttagtttattatngaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaanntaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaatcttttgngtctccccctttttacacagataattatttttgtcataacactttttaattgtttttcatcataggggcctttgctgaactacaaaaatgtgtaacaaattaaaatctgatgtgaatgatattaatgctacttttagcaaactgggcttcctaatacaaaattttaaatttccatttgtatcatgcttttaatatgcactgtaaatttcattaacttaaacattttttaatagccatggaactgacttcttaaaatctgttgcctataaatatttcactgctaagtacatacagaaaaacagtaattattgttttgccaaaattttatttttctacatattgagagtgtgttctccattttattcagaattcatagtaaagaagatagaaaggcagagaaa

SEQ ID NO: 81 - DNA, 471 bp, Homo sapiens
ctacttgggaggatcccttgagcccaggagttcaagaccagcctggcaagacatagcaagatcctagctctttaaaaaaaaatagtaattccccttcctcaaaattatattaataaggctacttcatctggacattcatcagtctcaaggtatggttcatctggagacagaatcattcctgcacttggtacttttggagtctgtttattcacctcacaattttaagtactttatatttaacaaaatacaaaaactgggtgctttcataaatgttttctcatctaattcttggaacagcttagtggagtatttaatattatcccccattttacagatgcagacctctgttgaatgactgccagacgtaagggttctgctttgagaaactgatagaatccaatttatgttctgtagattatgctgtttccatctcacttcaataaatacttatcaagcaaaaaaaaaaaaaaa

SEQ ID NO: 82 - DNA, 1426 bp, Homo sapiens
gcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaaca

SEQ ID NO: 83 - DNA, 1916 bp, Homo sapiens
ggcacgagggccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggataaataaaaaaaaaaaaaaaaaaaaaaaaaaaaaaaaaaaa

SEQ ID NO: 84 - DNA, 5210 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcctgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccag

SEQ ID NO: 85 - DNA, 417 bp, Homo sapiens
acctcccaaccaagccctccagcaaggattcaggagtgcccctcgggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatccaggaggggcctctgaaatttcccacaccccagcgcctgtgctgaggactcccgccatgtggccccaggtgccaccaataaaaatcctaccg

SEQ ID NO: 86 - DNA, 6234 bp, Homo sapiens
  modified_base (5479)..(5479): a, c, g, t, unknown or other
  modified_base (5546)..(5546): a, c, g, t, unknown or other
  modified_base (5557)..(5558): a, c, g, t, unknown or other
  modified_base (5560)..(5562): a, c, g, t, unknown or other
  modified_base (5565)..(5565): a, c, g, t, unknown or other
  modified_base (5567)..(5570): a, c, g, t, unknown or other
  modified_base (5572)..(5575): a, c, g, t, unknown or other
  modified_base (5741)..(5741): a, c, g, t, unknown or other
  modified_base (5749)..(5749): a, c, g, t, unknown or other
  modified_base (5756)..(5756): a, c, g, t, unknown or other
  modified_base (5766)..(5766): a, c, g, t, unknown or other
  modified_base (6056)..(6058): a, c, g, t, unknown or other
  modified_base (6061)..(6063): a, c, g, t, unknown or other
  modified_base (6065)..(6067): a, c, g, t, unknown or other
  modified_base (6074)..(6096): a, c, g, t, unknown or other
attcaccaagtttcacgcatctgctggcctccccctgtatttcctctaagccccagcctcagtttctctttctgcccacatactggccacacaattctcagccccctcctctccatctgtggtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagaatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctatttttattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttccttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcccctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctacctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtagcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcttgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggccccctggggcttacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataagagcagatagagtgtttgggggaggtagccaaccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccacgctcaagtgatcctccctcttcagcttcccaaagtgctgggattacatgcatgatccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaaggtggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttcgttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggaagtagggagggaggagggtgccactgatcccctgaacccctgcctctgcctccagngtgcccctccggcctcgccatgaggctcttcctgtcgctcccggtcctggtggtggttctgtcgatngtcttggaagnnannngtngnnnngnnnncttggctacttgggaggctgagacaggagaactgcttgaacctaggaggcggaggttgcagtaagccgagatcgcaccatttgacacagcaagtctccgtctcaaaactacaacaacaacaacaacaacaaccaaattttgcacccctgcctcatcttcctggcanggcccagnccccagncccagggganccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaannnaannnannnaaaaaannnnnnnnnnnnnnnnnnnnnnnttctctctggccaggcatggtggctgacgcctgtaatcccagcactttgggaggctgaggcgggcggatcacaaggtcaggagattgagcccatcctggctaacacggtgaaaccccgtctcttactaaaatacaaaa

SEQ ID NO: 87 - DNA, 3379 bp, Homo sapiens
aattccgcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcgaagggaggcagcagacgggccatgcggcacggtgaccgggagctggccggggctgggcgcatgcgccgtgggctcctgtatgacagcgatgaggaggacgaggagcgccctgcccgcaagcgccgccagtggagccggcacggaggacggcgaggaggacgagcagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctcggcggctgccccgctccaaggacgccattctcctcgcagatctggtggacagctgcaacgcaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggccctgctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtggccgtcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgagtcatggcggaggcccacgcgcgcatccatctgcgggactatgtgatcgaagacgacgtcaacatggccatccgcgtgatgctggagagcttcatagacacacagaagttcagcgtcatcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctcgctttggccagagagctggttgaagatgtttgtaatcgttttcagtctcctgcaggtttctgtgcccctgtggtggaagaggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaaaaaaaaaa

SEQ ID NO: 88 - DNA, 1163 bp, Homo sapiens
ccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctcc

SEQ ID NO: 89 - DNA, 1530 bp, Homo sapiens
aatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtgggccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggtaaaaaaaaaaaaaaaaaa

SEQ ID NO: 90 - DNA, 3927 bp, Homo sapiens
gaattccggcccccgtgtctgggcgtccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacgtcgcgggggctccacagtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgtgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgcagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcaaaaaaaaaaaaaaaaaaaaaaaaaaaaaaaaaaaaaaaaaaaa

SEQ ID NO: 91 - DNA, 2510 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcactcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacgatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaaaaaaaaaaaa

SEQ ID NO: 92 - DNA, 4501 bp, Homo sapiens
gatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttaaaaaaaaaaaaaaaaaaaaaaaaaaaaaaaaaaaaaaaaaaaaaaaaaaaaaaaaaaaaaaaaaaaaaaaaaaaagg

SEQ ID NO: 93 - DNA, 2164 bp, Homo sapiens
  modified_base (80)..(80): a, c, g, t, unknown or other
  modified_base (90)..(90): a, c, g, t, unknown or other
  modified_base (94)..(94): a, c, g, t, unknown or other
  modified_base (99)..(99): a, c, g, t, unknown or other
  modified_base (107)..(107): a, c, g, t, unknown or other
  modified_base (112)..(113): a, c, g, t, unknown or other
  modified_base (127)..(127): a, c, g, t, unknown or other
  modified_base (150)..(150): a, c, g, t, unknown or other
  modified_base (161)..(161): a, c, g, t, unknown or other
  modified_base (192)..(192): a, c, g, t, unknown or other
  modified_base (331)..(331): a, c, g, t, unknown or other
  modified_base (397)..(397): a, c, g, t, unknown or other
  modified_base (889)..(889): a, c, g, t, unknown or other
  modified_base (1013)..(1013): a, c, g, t, unknown or other
  modified_base (1059)..(1059): a, c, g, t, unknown or other
  modified_base (1120)..(1120): a, c, g, t, unknown or other
  modified_base (1275)..(1275): a, c, g, t, unknown or other
  modified_base (1359)..(1359): a, c, g, t, unknown or other
  modified_base (1517)..(1517): a, c, g, t, unknown or other
  modified_base (1557)..(1557): a, c, g, t, unknown or other
  modified_base (1588)..(1588): a, c, g, t, unknown or other
  modified_base (1597)..(1597): a, c, g, t, unknown or other
  modified_base (1643)..(1643): a, c, g, t, unknown or other
  modified_base (1651)..(1651): a, c, g, t, unknown or other
  modified_base (1685)..(1685): a, c, g, t, unknown or other
  modified_base (2140)..(2140): a, c, g, t, unknown or other
  modified_base (2142)..(2142): a, c, g, t, unknown or other
tttcaatatatttgtatgaattgtaagaatatgcatcttaaaatggcaagttttccatatttttacaactcactggtggntttccgcatncttngtacncccatganagaanncttttatgcaaggntcttgcatttaaaagacagcttngcgaatatttngtaaattacagtctcactcagaactgttttnggacacatttaaggtgtagtattaataggttaaaaccaggctttctagaaagaataaacttacatatttatttttaggacatgaaaatagcaatattcttggagattgataaccatagcattaatacgcccattatggntcatttaaattggggtttatttcagcaaacttgttgaatttatttttaagaaagaaatactgtatngggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaatnggtgatgggtgatggagggttcagagaggagtgatcgtcagatgtgtgaatggacggtttaggtgaaaataatcaactgcatagttcccatgcacgctgggcaatgagaatccttggaaacatnggtgatgctatcagttttatagctttatttcttaagggggtagggnaaaattagttcccattctttcaacccccttaactgtatagctcttttcctagaatagtgangcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgatttngagggtttttaaaaataaagcaaggttgactaacctacggccacgggaacaggaccatggttaagcaaccatatagaaagcttngttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggtttnatttatttcttttttgccaaatagagtgtggattcatttnaggggctagctaagccaagaggcagtggttngggcttgtngtttgtaacaagaaaatgatccacaccactcccccgattcccgggntgcagaanttgtaactcggggttgggcctctatatggagtgnaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcananaaaaaaaaaaaaaaaaaaaaaa

SEQ ID NO: 94 - DNA, 713 bp, Homo sapiens
  modified_base (18)..(18): a, c, g, t, unknown or other
  modified_base (20)..(22): a, c, g, t, unknown or other
  modified_base (25)..(25): a, c, g, t, unknown or other
  modified_base (28)..(28): a, c, g, t, unknown or other
  modified_base (581)..(609): a, c, g, t, unknown or other
  modified_base (611)..(611): a, c, g, t, unknown or other
  modified_base (629)..(629): a, c, g, t, unknown or other
  modified_base (635)..(635): a, c, g, t, unknown or other
  modified_base (645)..(648): a, c, g, t, unknown or other
cccacgcgtccgccgggngnnntcngtnggcggcggattcgaacgttcggactgaggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtgaaaaaaaaaaaaaaaaaaannnnnnnnnnnnnnnnnnnnnnnnnnnnnanaaatttaataaaaaaaanaaaaanaaaataaaannnntcttttggggggggcccggccccaattccctttaaggggcgtttaaaaatcacggccggggttaa

SEQ ID NO: 95 - DNA, 3294 bp, Homo sapiens
  modified_base (1)..(1): a, c, g, t, unknown or other
  modified_base (762)..(762): a, c, g, t, unknown or other
  modified_base (777)..(777): a, c, g, t, unknown or other
  modified_base (783)..(783): a, c, g, t, unknown or other
  modified_base (1360)..(1360): a, c, g, t, unknown or other
  modified_base (2004)..(2008): a, c, g, t, unknown or other
  modified_base (2010)..(2010): a, c, g, t, unknown or other
  modified_base (2183)..(2183): a, c, g, t, unknown or other
  modified_base (2237)..(2237): a, c, g, t, unknown or other
  modified_base (2245)..(2245): a, c, g, t, unknown or other
  modified_base (2354)..(2354): a, c, g, t, unknown or other
  modified_base (2372)..(2372): a, c, g, t, unknown or other
  modified_base (2379)..(2380): a, c, g, t, unknown or other
  modified_base (2383)..(2383): a, c, g, t, unknown or other
  modified_base (2394)..(2394): a, c, g, t, unknown or other
  modified_base (2400)..(2400): a, c, g, t, unknown or other
  modified_base (2410)..(2410): a, c, g, t, unknown or other
  modified_base (2557)..(2557): a, c, g, t, unknown or other
  modified_base (2683)..(2683): a, c, g, t, unknown or other
  modified_base (2689)..(2689): a, c, g, t, unknown or other
  modified_base (2768)..(2768): a, c, g, t, unknown or other
  modified_base (2784)..(2785): a, c, g, t, unknown or other
  modified_base (2838)..(2838): a, c, g, t, unknown or other
  modified_base (2862)..(2862): a, c, g, t, unknown or other
  modified_base (2880)..(2882): a, c, g, t, unknown or other
  modified_base (2884)..(2884): a, c, g, t, unknown or other
  modified_base (2905)..(2905): a, c, g, t, unknown or other
  modified_base (3094)..(3094): a, c, g, t, unknown or other
  modified_base (3126)..(3126): a, c, g, t, unknown or other
  modified_base (3134)..(3134): a, c, g, t, unknown or other
  modified_base (3150)..(3150): a, c, g, t, unknown or other
  modified_base (3152)..(3152): a, c, g, t, unknown or other
  modified_base (3166)..(3166): a, c, g, t, unknown or other
  modified_base (3182)..(3182): a, c, g, t, unknown or other
  modified_base (3184)..(3184): a, c, g, t, unknown or other
  modified_base (3187)..(3187): a, c, g, t, unknown or other
  modified_base (3231)..(3231): a, c, g, t, unknown or other
  modified_base (3233)..(3234): a, c, g, t, unknown or other
  modified_base (3237)..(3241): a, c, g, t, unknown or other
  modified_base (3243)..(3244): a, c, g, t, unknown or other
nggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagnccccccaaaaaaaanaaaaanaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatngcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaannnnnantggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcanaactcacttggcatctaacagtccattttcattgtttccaaataccatagcaanctcttgcnctttgtgttacccctagagagatggcacccaatccccagggttgctctctgacttccaccattcactgacttttattgccagaggagctcccaggaatccacagttctnggaagagaggggctctangtctttnntgnggagaataccnacccancttccctcantgcagacgatagacacactcagtgtcagggtagggtggcaggttcagctggtacttcttttccagagcaggtggcacaaaacgaccccccaggtaatggtagcgaccggtaaactgggttgcagattttttgggggctgtgaggganatgagcaagtctggctggatccctccagcatttcccttctccacgtcccatcctgagggaatgtcgatgctggcaatgggcacagtgagtcccttcaggacactcaggatgctgtggaacggttcncgaacntcgcccttgaagctgaagccaaagatggcatccaccaccagctcatacagttcatcaatcgtcatgggctctgcgggcntttccccaaggaaagnnatgtccattttctgacactgggtcaccaatgcagtgaagaggggcttgttagnccttttggggtaatagatggttgnctcgtagccaaagagttnnngntgtcgagcacagaccagaccntctcctccattattccccgggccacagatgaccaggacagtaggggggctcctggacatggacgtggggggatatgccttggcgatggctgtagcacagctcagcccggccagttccataagttggtccacgctgaactggtattcgttaaatagctcctggtccacggcctgggcctcctcctggctnaggtacttcaccaccgtgctcgccatgacctntgagtccnagcggccacccgagtncngccgctgcggtccncaccaggtgggtcccnangcnacaggcgatggtctggcttttgatccgcggcaggcgcgagcccncnnccnnnnncnngaggcccagcagcgcccgcagcctggacatccagctccagagcgcgcgcc

SEQ ID NO: 96 - DNA, 1885 bp, Homo sapiens
  modified_base (228)..(228): a, c, g, t, unknown or other
  modified_base (291)..(291): a, c, g, t, unknown or other
  modified_base (493)..(493): a, c, g, t, unknown or other
  modified_base (681)..(681): a, c, g, t, unknown or other
  modified_base (714)..(715): a, c, g, t, unknown or other
  modified_base (854)..(854): a, c, g, t, unknown or other
  modified_base (960)..(960): a, c, g, t, unknown or other
  modified_base (1217)..(1217): a, c, g, t, unknown or other
  modified_base (1409)..(1409): a, c, g, t, unknown or other
  modified_base (1489)..(1489): a, c, g, t, unknown or other
atcttgggaccatgcacacagtgccttggggagtagattttgccctaatagcgatgaagaattttatcagtcagtggagttcctttttcagatcagggatgggaaagagccaaactgggtacctcccacgtgtgccccgtgaacagccctttgcagctgggctgtggggcttggctgctgccctgtcccatctggcagttaacgccttctccctgctctgccccccantccccaaaaccagttgcagcctcaacccacatggggatgtagaaagccgtaaagtccacgctnctgttgaaaatgtttacatctccgctctcaacctgccttgggttcgtgttaaatggtgttaaattctgcaaatggaggggaaaaaaatcaaattctaaatttcaaagtagaatttaaagcaaatttgtaaaaaaattatcctaccaccccttttggtccacttaagatatgccacgctgaagcaaggtatttcctactggantttgctttcactggtgtttagaaaataaacttgatttctctaggagcactcctttggttagagggatgcaagaaggagaggtgaaggtggcgtgtggtggctcatgcctgtaatcccagcactttggggaggccgaggcaggcggatcacttgaggccagcagtttgagaccagcctggccaacatgntgaaaccccatctctactaaaaatacaaaaaannagctgggcatggtggcaggcacctgtaatcccagttacttgggaggctgaggcaggagaattgcttgaacccaggaggtggaggttgcagtgagctgagattgtgccactgcacttcagcctgggcgacagagtgactnctgtcaaaaaggaaaggcaaaaaccggaccctggagctctgtgggccctgattgcaggcccctccctgtgtgatgagggatgagtcagcttggggagccacttggncagcctgcatgcctggtcatcaggaggttgagaaaagccttgaaagttgtgaagcactgagcagatacaagtgtttgttaattttgtagaaattaactttcccatctggcctttatctccaaagttggtattgttgctccacgcagactgcagtccggtttcttattgtgactttgacaatgcaaagtgcaaaataggaagaggcctccccaccccactatcccaccctggtgaccaattcagtgtaaccattgcangtactcagtcattggtgtctttggagtgacatctgcagccagttagtgccacctgagtacagcactcgtacttttacatgatgtgtgtgtgagtagctcttctgtccaaaccatgatttgaggttcaactacctgtagatcaaagctttattttagaacgataaactgattttttccaaatgggtgaaatcnttctccccatgactatgttttcttaactttgcattgaatctatttactgggttacattctatgtgtagtttgctttcttncatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgcacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatcttcgaaaaaaaaaaaaaaaaaaaaaaaa

SEQ ID NO: 97 - DNA, 1695 bp, Homo sapiens
ggcacgagggtgcaatttcagctcactgcaacctcagcctcctgagtagctggggggtcataggtgcatgccaccatgcccagctaattttttttctatttttagtcgagacagggttttatcacgtatgccaggctggtctcgaactcctgaccttaggtgatccacccgcctcagcctcccaaagtgcagggattacggcatgagccaccacgcctggcctattcaagaatattgagggacagaaaatatctatatatatccatcctcagaaccttaaatatacaggtcactacagtctttattattttaatttttgtttcttagggtttcttttggtggtggttttttgagatggagcatcattccgtctcccaggctgtagtgcagtggcacaatcttggctcactgcaagctccgcctcccgggttcacgccattctcctgcctcagcctcccgtcttaggtctttttgaaagaggttatgcctctgttgcctagtctggagtggtgcaatggtgtgatcttggctcactgcaacctccacctccaggtcttaagagatcctccctgctcagcctcgtgagtagctagaaccgcaggtgcatgccaccacagctaattcttgtattttttatagagagtgtttcgccatattgtccaggccgggctcaaacccctgatcttaagtgatctatctgccttagcctcccaatgtgctgggtttacaggcgtgagccactatgcccagcccctttttaattttttaaaaatgtttatttttgagatggagtttcgctcttgttgccccaactggagaccaatgacatgatctcagctcactgcaacctccgcctcccgggttcaactgattctcctccctcagcctccggaaaagctgggattacaagcatctaccatcatacctggctaattctgtatttttagtagagaaggggtttctctatgttggtcaggctggtctccacctcccgacctcaggtgatctgcctgccttggcctcccaaagtgctgagattacaggcttgagccactgtgcccggccaaatttttattatttttaaattagaggtggggtctcaccatgttgaccagtttggtctcgaacttctggcctcagtcccttgtcttggcctcccaaagtgttggggtttcaggtgttagaccccatgcccaaccactacagtttttgtttttgtttttgtttttgtttcagacggagtcttgctctgtcgcccaggctggagtgcagtggcgcaatcttggctcacggcaagctccacctcccgggttcacgccattctcctgcctcagcctccccagtagctgggactaaaggtgcccgccaccatgcccggctaatttttttgtatttttagtagagacagggcttcaccatgttagccaggctggtctcaaactcctgacctcagttcatccacccgccttggccttccaaagtgctgggattacaggcatgatccactgcgcccggcctcactgccattttatagatgagaaagccaagttccagaaaagttgtgaaatagacggtgacaaaactataaaactgggactagagatagtatcctaatgcttgttgattgtttttgtccatactgattgtcaacctaccaatataatctaccatcaagtcaaaaaaaaaaaaaaaaaa

SEQ ID NO: 98 - DNA, 843 bp, Homo sapiens
  modified_base (46)..(46): a, c, g, t, unknown or other
  modified_base (48)..(50): a, c, g, t, unknown or other
  modified_base (52)..(68): a, c, g, t, unknown or other
  modified_base (70)..(70): a, c, g, t, unknown or other
  modified_base (72)..(73): a, c, g, t, unknown or other
  modified_base (75)..(77): a, c, g, t, unknown or other
  modified_base (98)..(98): a, c, g, t, unknown or other
  modified_base (220)..(220): a, c, g, t, unknown or other
  modified_base (296)..(296): a, c, g, t, unknown or other
  modified_base (355)..(355): a, c, g, t, unknown or other
  modified_base (410)..(410): a, c, g, t, unknown or other
  modified_base (500)..(506): a, c, g, t, unknown or other
  modified_base (519)..(528): a, c, g, t, unknown or other
  modified_base (532)..(532): a, c, g, t, unknown or other
  modified_base (535)..(535): a, c, g, t, unknown or other
  modified_base (539)..(539): a, c, g, t, unknown or other
  modified_base (541)..(541): a, c, g, t, unknown or other
  modified_base (544)..(544): a, c, g, t, unknown or other
  modified_base (546)..(548): a, c, g, t, unknown or other
  modified_base (552)..(552): a, c, g, t, unknown or other
  modified_base (557)..(558): a, c, g, t, unknown or other
  modified_base (562)..(567): a, c, g, t, unknown or other
  modified_base (569)..(574): a, c, g, t, unknown or other
cccaactctacaaaaaacgaaaaattagccgggagcggtgatgtgngnnngnnnnnnnnnnnnnnnnngngnntnnngtggaagaatcacttgagccngggaggttgaggctgcagtgagctgtgtttataccactgcactccagcctgctgggtaacagagcaagactccatctcaaaaagaaaagaaaaaatgctttgctacataatgaggccaggcnaaaaaaaaaaagtcctgtggaaatcatatagacaaacatttgcaaagctgctactgccattgtaccagtgttaaantgtgttctaccttgcatcttttactgatttttatgacagattttatattgtaaccattngagaactctgtaagtgctatggcttccttaaactacgatttatcatatgctcccngtgtttactttgagactgaatggcaaccagagaatgtaaacaaccaaggtgcatctggttatgttttaaaataaagattaataaaagttnnnnnnnttctctttctaannnnnnnnnnaaantanaaananaanannnatanaaaannaaannnnnncnnnnnncggtggctcatgcctataatcccagcactttgggaggccgaggcaggcagatcacctgaggtcaagagttcgagaccagtctggccaacatggtgaaaccctgtctctactaaaaatacaaaaattagccgggcatagtggcagacacctgtaatcccagctactgggaaggctgagccagaatggcttgaacctgggaggcagaggttgcagtgagccgagatcgccccattgcactccagcttgagcaacaagagcgaaactgtctc

SEQ ID NO: 99 - DNA, 1773 bp, Homo sapiens
  modified_base (52)..(57): a, c, g, t, unknown or other
  modified_base (60)..(66): a, c, g, t, unknown or other
  modified_base (109)..(109): a, c, g, t, unknown or other
  modified_base (111)..(111): a, c, g, t, unknown or other
  modified_base (449)..(449): a, c, g, t, unknown or other
  modified_base (990)..(990): a, c, g, t, unknown or other
  modified_base (1720)..(1728): a, c, g, t, unknown or other
aggttgcagtgaactgagatcacaccactgtactccagttgaggcgacagannnnnnccnnnnnnnaaaaaaaaaaaaaagtgtgtgtgtgtgtatatatatgtatatntntatacacacacacacactttccaataccagtcggcattacccgccctttggtttcttttgctttggatttcagcccccatatcatttctggtaacagagcacagcaatagaatttctgggaagcagaccttgtgaatcgtgcctgtgtcttaattcacaaagggtaagtgaatgccgttgaaaggtgtttcatacacttaccccagaaatgagagcctgtctcatgcaggagtcgggaggcagcgatgtcagggaactgggactatgtctttatgactgtgatggtggtaaccaagtggggtggtcccctctggggagctgagtaagaacgcaaaggnttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtntgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgtgtgtgtgtgtgtgcactttagtttcgtgagccttgggaaactgattctacaaatatcttatatagagataaatgtatcaggcatttttttgcaaagcgatatatacattcctcttatttattaaatcactggctttggtgttatgtagagatatttgtagatctcagaacagaattaaaatattgtgaaaattacagcttaataaatgtttattgtaannnnnnnnnatggacttttaaaatatatctcatcacttctaaccaaaaaaaaaa

SEQ ID NO: 100 - DNA, 1855 bp, Homo sapiens
ttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactatgatgacatgtctgtagctatcagaaagagaagctgggaagaacatgtgacccactggatgggacagccttttaattctgatgatcgtaacacagcatgtcatcatggactagtagctgacagcttgcaggcatgtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatatccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacacgatgagttcttggatattccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgcggtaaaatcagtaaagttggaagtggatgaagataagagcacaaagggatccaatttttccaactcggaagtggcaattggtttgtctccttacacctttccccagaagaggcttttccatgttgctggagaagaaaacatcacctaggccggtgtgtgcctggcagaacactgcactccaatttcctcgggcagccacaaaaaaaaaaaaaaaaaa

SEQ ID NO: 101 - DNA, 2063 bp, Homo sapiens
  modified_base (695)..(695): a, c, g, t, unknown or other
  modified_base (732)..(732): a, c, g, t, unknown or other
  modified_base (755)..(755): a, c, g, t, unknown or other
  modified_base (804)..(804): a, c, g, t, unknown or other
  modified_base (807)..(808): a, c, g, t, unknown or other
  modified_base (812)..(813): a, c, g, t, unknown or other
  modified_base (816)..(816): a, c, g, t, unknown or other
  modified_base (818)..(818): a, c, g, t, unknown or other
  modified_base (824)..(824): a, c, g, t, unknown or other
  modified_base (826)..(826): a, c, g, t, unknown or other
  modified_base (829)..(831): a, c, g, t, unknown or other
  modified_base (836)..(837): a, c, g, t, unknown or other
  modified_base (839)..(840): a, c, g, t, unknown or other
  modified_base (1469)..(1469): a, c, g, t, unknown or other
  modified_base (1490)..(1490): a, c, g, t, unknown or other
  modified_base (2014)..(2014): a, c, g, t, unknown or other
  modified_base (2018)..(2018): a, c, g, t, unknown or other
  modified_base (2022)..(2038): a, c, g, t, unknown or other
ctctgcccattgggaaacacctctctatgactctataaatgtccaaggtggccccaagggaggacttctgcagcacagctcccttcccaggacgtgaaaatctgccttctcaccatgaggcttctagtcctttccagcctgctctgtatcctgcttctctgcttctccatcttctccacagaagggaagaggcgtcctgccaaggcctggtcaggcaggagaaccaggctctgctgccaccgagtccctagccccaactcaacaaacctgaaaggacatcatgtgaggctctgtaaaccatgcaagcttgagccagagccccgcctttgggtggtgcctggggcactcccacaggtgtagcactcccaaagcaagactccagacagcggagaacctcatgcctggcacctgaggtacccagcagcctcctgtctcccctttcagccttcacagcagtgagctgcaatgttggagggcttcatctcgggctgcaaggaccctgggaaagttccagaactccacgtccttgtctcaattgtgccatcaactttcagagctatcatgagccaacctcagccttccgagtagctgggattacaggtgtgcgccaccacacccggctaatttttgctttttttttttttgagacagaatctcgctctgttgctcaggctggagtggagtgcagtggcacnatctcagctcactgcagcctctgcctcccgggttcangagattctcctgactcaacctcntgagtagctgggattacaggtgcctgccactatgcctagctaatttttntanntttnntgnanacgggntnttnnnatgtnngnnagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtantcctagcaccttgggaggccnaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacncagnaaannnnnnnnnnnnnnnnnaaaaaaaaaaaaaaaaaaaaaaaaa

SEQ ID NO: 102 - DNA, 1704 bp, Homo sapiens
ggcacgagggagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcggcccagcgccggccttcgggtcccaccttgcgggtgatgttgtgcacgtaggggcacgtgttgcaggcgaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacagtaactgtcagcataaacctgggggccctcaggactaggacagggtgagccagtgctccctcctttcatgtacttggcctgagactgacctctccctaggtccaaatgccctagtcacatggcagacccacggcctggcccactgtataaaataaacctgtttgcttcttaaaaaaaaaaaaaaaaaaaaaa

SEQ ID NO: 103 - DNA, 1015 bp, Homo sapiens
  modified_base (144)..(144): a, c, g, t, unknown or other
  modified_base (703)..(703): a, c, g, t, unknown or other
  modified_base (937)..(937): a, c, g, t, unknown or other
  modified_base (1010)..(1010): a, c, g, t, unknown or other
agagctgcgcgccgcggtggcggaagatggctgcggtcgaggtggcggacactcggctgatgcttggagtcgggctgatcgaaaaggacacaaatggagaagttctgtgggtgtggtgttatccttccacgacagccacattanggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggcttcatcaaagacattgtatctcagtttggaatgggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaancctgcagatgtgcacaggttacgtcgctggatttgtagacttggaggtgagcaacagaccagacctctatgatgtgtttgtgaatctggcagagagtgagattaccattgctccccttgcaaaagaggccatggcaaatgggcaaacctgcacaaaagaaattggggtcagctaattggttcaagtcctgcagaagatccaggagaaattcagaggagccacgttataccaggntattgctctaaaaacaaggggaaatcttttaccaacctaggcaccatttttcagaagtttcgggctgaatggngaaaa

SEQ ID NO: 104 - DNA, 3589 bp, Homo sapiens
  modified_base (11)..(13): a, c, g, t, unknown or other
  modified_base (652)..(652): a, c, g, t, unknown or other
  modified_base (725)..(725): a, c, g, t, unknown or other
  modified_base (734)..(734): a, c, g, t, unknown or other
  modified_base (863)..(863): a, c, g, t, unknown or other
  modified_base (945)..(945): a, c, g, t, unknown or other
  modified_base (952)..(952): a, c, g, t, unknown or other
  modified_base (1107)..(1107): a, c, g, t, unknown or other
  modified_base (1154)..(1154): a, c, g, t, unknown or other
  modified_base (1286)..(1286): a, c, g, t, unknown or other
  modified_base (1288)..(1295): a, c, g, t, unknown or other
  modified_base (1297)..(1297): a, c, g, t, unknown or other
  modified_base (1299)..(1299): a, c, g, t, unknown or other
  modified_base (1835)..(1835): a, c, g, t, unknown or other
  modified_base (1927)..(1927): a, c, g, t, unknown or other
  modified_base (1986)..(1986): a, c, g, t, unknown or other
  modified_base (2083)..(2083): a, c, g, t, unknown or other
  modified_base (2242)..(2242): a, c, g, t, unknown or other
  modified_base (2265)..(2265): a, c, g, t, unknown or other
  modified_base (2896)..(2896): a, c, g, t, unknown or other
  modified_base (2904)..(2904): a, c, g, t, unknown or other
  modified_base (2909)..(2909): a, c, g, t, unknown or other
  modified_base (3071)..(3071): a, c, g, t, unknown or other
cacgaggaaannngcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctggngaagcaattgaaacactattaaccctgtgtatagtgtcaacagttaaagcagacgaaacgaagtaagctatantttctgganctgaacaaagctctgctgtttagagcatttaagtttgtttagtggatccatactcaaaggaaagcataagcaaattttcctttacaatgcaaacatgccactggtggcagcacatggtaatttgtggantttttttttcatactcaagtaatggaggctagaaatgaagagaaccttctttttctcttgactttgacagcacatgctaaanatctctnccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacnaaggacttctggcaaaatgattgagtccttcaagtttaaactaacanttggcaacagcaaattaaacgtttttaagatgtaaagaaagggttaccgcttgctaaggacttcagacaccatgtccgaaacctgttcctctcaagtgccctgttgtgtggaacacttcacatattggcgcncnnnnnnnnangnggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgantttttttttaaactgcgagtcccttaagatcacgtttgtcaagtgtgtattcacacatttacttaaatcaagggactcaatgcttgcttttnattttaaccatcttttactatttttagaaggaaactagctttagtagtgggttgccctntatgttttctctttttgctcttaatatgccattgggtttttgtgtgtatgtgattttcaaaattcatgacttgaagtgcaaggacagatctagatgnttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcanttttggacaactactgtaatcantttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttcnttttttgntttgntttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctggnggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttcaaaaaaaaaaaaaaaaaaaaaaaaaa

SEQ ID NO: 105 - DNA, 1821 bp, Homo sapiens
ggccggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgttt

SEQ ID NO: 106 - DNA, 1633 bp, Homo sapiens
aaagaagaaccatgaggctcatcctgcctgtgggtttgattgctaccactcttgcaattgctcctgtccgctttgacagggagaaggtgttccgcgtgaagccccaggatgaaaaacaagcagacatcataaaggacttggccaaaaccaatgagcttgacttctggtatccaggtgccacccaccacgtagctgctaatatgatggtggatttccgagttagtgagaaggaatcccaagccatccagtctgccttggatcaaaataaaatgcactatgaaatcttgattcatgatctacaagaagagattgagaaacagtttgatgttaaagaagatatcccaggcaggcacagctacgcaaaatacaataattgggaaaagattgtggcttggactgaaaagatgatggataagtatcctgaaatggtctctcgtattaaaattggatctactgttgaagataatccactatatgttctgaagattggggaaaagaatgaaagaagaaaggctatttttatggattgtggcattcacgcacgagaatgggtctccccagcattctgccagtggtttgtctatcaggcaaccaaaacttatgggagaaacaaaattatgaccaaactcttggaccgaatgaatttttacattcttcctgtgttcaatgttgatggatatatttggtcatggacaaagaaccgcatgtggagaaaaaatcgttccaagaaccaaaactccaaatgcatcggcactgacctcaacaggaattttaatgcttcatggaactccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggccaaagttgcaaagattggcactgatgttctatcaactcgatatgaaacccgctacatctatggcccaatagaatcaacaatttacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccctcagtttctcacagattttcaccatgtggcttcatcaatttatgtgctaatacaataaaataaaatgcactt

SEQ ID NO: 107 - DNA, 4869 bp, Homo sapiens
  modified_base (340)..(340): a, c, g, t, unknown or other
  modified_base (342)..(342): a, c, g, t, unknown or other
  modified_base (344)..(346): a, c, g, t, unknown or other
  modified_base (348)..(348): a, c, g, t, unknown or other
  modified_base (350)..(352): a, c, g, t, unknown or other
  modified_base (715)..(715): a, c, g, t, unknown or other
  modified_base (1285)..(1285): a, c, g, t, unknown or other
  modified_base (2033)..(2033): a, c, g, t, unknown or other
  modified_base (3378)..(3383): a, c, g, t, unknown or other
  modified_base (3385)..(3385): a, c, g, t, unknown or other
  modified_base (3699)..(3699): a, c, g, t, unknown or other
  modified_base (3988)..(3988): a, c, g, t, unknown or other
  modified_base (3990)..(3990): a, c, g, t, unknown or other
  modified_base (3994)..(4001): a, c, g, t, unknown or other
  modified_base (4064)..(4065): a, c, g, t, unknown or other
  modified_base (4069)..(4069): a, c, g, t, unknown or other
  modified_base (4084)..(4084): a, c, g, t, unknown or other
  modified_base (4105)..(4105): a, c, g, t, unknown or other
  modified_base (4115)..(4115): a, c, g, t, unknown or other
  modified_base (4126)..(4126): a, c, g, t, unknown or other
  modified_base (4140)..(4140): a, c, g, t, unknown or other
  modified_base (4146)..(4146): a, c, g, t, unknown or other
  modified_base (4149)..(4150): a, c, g, t, unknown or other
  modified_base (4170)..(4170): a, c, g, t, unknown or other
  modified_base (4177)..(4177): a, c, g, t, unknown or other
  modified_base (4185)..(4185): a, c, g, t, unknown or other
  modified_base (4189)..(4189): a, c, g, t, unknown or other
  modified_base (4855)..(4856): a, c, g, t, unknown or other
  modified_base (4860)..(4862): a, c, g, t, unknown or other
gactacgcggctcagaagaagactggtctctcaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccncntnnncngnnngtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccagnggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcnctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctngggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatnnnnnnantctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggaccntggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattntnttannnnnnnngtttgcacatatttttataggtatcttaggcatcgattggtattttttaactgggccaagccnnttanggtctttcttctgtngggtgctatcattttctgatnaagtcttttngactattgacntacagtctttcacngatggnggnntgtttttcccccaaatctgntgtttgncttataantgtngtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaaaaaaannaaannnaaaaaaa

SEQ ID NO: 108 - DNA, 1591 bp, Homo sapiens
tctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaaaaaaaaaaaaaaaaaaaaaaa

SEQ ID NO: 109 - DNA, 2337 bp, Homo sapiens
  modified_base (1)..(8): a, c, g, t, unknown or other
  modified_base (633)..(633): a, c, g, t, unknown or other
  modified_base (1229)..(1229): a, c, g, t, unknown or other
  modified_base (2058)..(2058): a, c, g, t, unknown or other
  modified_base (2127)..(2127): a, c, g, t, unknown or other
  modified_base (2314)..(2320): a, c, g, t, unknown or other
  modified_base (2322)..(2322): a, c, g, t, unknown or other
nnnnnnnngcgagtccgagcgccgccatggctctgctgtccgagggcctggacgagctgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttntggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccaggnctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcnatgacagaccacgtatatgttggcagtctcataagattataatactgtatttttactataccttttctntgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttannnnnnnanaaaaaaaaaaaaaaa

SEQ ID NO: 110 - DNA, 1900 bp, Homo sapiens
cctgacgggaccaaggcggcgggagtctgcggtcgttccctcggctgtggaccgggcggcacgacgcggtgcagggtaacatggcggatgcggaagtaattattttgccaaagaaacataagaagaaaaaggagcggaagtcattgccagaagaagatgtagccgaaatacaacacgctgaagaattttttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagta

SEQ ID NO: 111 - DNA, 3766 bp, Homo sapiens
cccagccaggacatggccgcacctctcctcatcaggagcgccggctcacggacttctcgcccaactccctgagcgctccctcgtttcgatctttagaaaaccctgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcagtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtgatggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtg

SEQ ID NO: 112 - DNA, 5747 bp, Homo sapiens
  modified_base (248)..(248): a, c, g, t, unknown or other
  modified_base (260)..(261): a, c, g, t, unknown or other
  modified_base (277)..(277): a, c, g, t, unknown or other
  modified_base (455)..(455): a, c, g, t, unknown or other
  modified_base (734)..(737): a, c, g, t, unknown or other
  modified_base (2501)..(2502): a, c, g, t, unknown or other
  modified_base (3443)..(3443): a, c, g, t, unknown or other
  modified_base (3586)..(3586): a, c, g, t, unknown or other
  modified_base (4479)..(4479): a, c, g, t, unknown or other
  modified_base (5157)..(5157): a, c, g, t, unknown or other
  modified_base (5161)..(5163): a, c, g, t, unknown or other
  modified_base (5166)..(5168): a, c, g, t, unknown or other
  modified_base (5170)..(5176): a, c, g, t, unknown or other
  modified_base (5178)..(5181): a, c, g, t, unknown or other
  modified_base (5183)..(5186): a, c, g, t, unknown or other
  modified_base (5188)..(5189): a, c, g, t, unknown or other
cgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggtgcctcatctccagacatggagcccagctatgggggaggtctctttgacatggtaaaaggaggtgcanggaggctctttnntaacctaaaggacaanttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggatnccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattnnnntgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaagaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagcccacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgatnntgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagnactaacaaatataaaggaacttgaaatgtggggagtgataatagtccagtgattaaactacagtccagtgattaccaccaactttctgactaagctaaaaatgaatgaaaatggtggctaaagaaaatagggactctgaagangtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgttngtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaataaaaaaanaaannnaannnannnnnnnannnntnnnnanncaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 113 - DNA, 1829 bp, Homo sapiens
  modified_base (69)..(69): a, c, g, t, unknown or other
  modified_base (217)..(217): a, c, g, t, unknown or other
  modified_base (722)..(722): a, c, g, t, unknown or other
  modified_base (725)..(726): a, c, g, t, unknown or other
  modified_base (733)..(744): a, c, g, t, unknown or other
  modified_base (748)..(749): a, c, g, t, unknown or other
  modified_base (751)..(753): a, c, g, t, unknown or other
  modified_base (803)..(803): a, c, g, t, unknown or other
  modified_base (824)..(824): a, c, g, t, unknown or other
  modified_base (849)..(849): a, c, g, t, unknown or other
  modified_base (860)..(860): a, c, g, t, unknown or other
  modified_base (868)..(868): a, c, g, t, unknown or other
  modified_base (1603)..(1609): a, c, g, t, unknown or other
  modified_base (1669)..(1669): a, c, g, t, unknown or other
  modified_base (1736)..(1736): a, c, g, t, unknown or other
tttgaaagcttgtgttttaacttctcaaacagagcagacaaaaggatcggcaaaaggaaatggacaatnttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcangatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatganaannaaaaaannnnnnnnnnnnaaannannncactaaaatgtgacctaggaaaaatatgaatggtgtttaggatgagaganaaggggaaaacaatagccctnggtcagctttataatagagagcctnggtttccctangcatgaangagatgtatgttgtagtcctgccactgattactgaagtcctgccattaattgctgaatgtcttcagttgggccactgagcttgtctgaatctgttcccttttataaaagagttactacatcaaaacaaagagtgaaatccaaatttgtcaaactgtatgtattaaacatgtccagttttttggttaaaaaaaaattgcactggctttgagggaaaacacacagggtgagggaattgggctaaatgacttcttacaggcccctttctgattctttaactttgaaaggcaagccatattgatccagttgttatagtgaactcatggtaatggtttgtgagaacaatagagattttcatttctatgtagatgagttggtatgagaatatatggaatttttaagggactgtttaaatctttgatttgtagactattaaatataccgtatgcataaagtaagcctttagctctaaggtaaagacgacacgttttcggtttgtgactacaaataggttaaaaatagattttaattttattaaaaatataatttaatgcaggttgtttgaagcatctgtcttcatatgatggcattagaacaccttggtataataaaaagttaccgtaatttatgattatttgaatttatccattctgaaaattaataagatctaaaactggcatgacaatcaagatttgtatttagtgaaatttaaaataaatgtaagccatagttaaaannnnnnntgcattcatgaatgcccttaggaaaaggtccacagtaaaatcagaaagctgaacctctcntgctgtttataggatatgtttatgctgaattaattgccagggtttcttaaacttttagggaattatnctttggtggctcaatagtagattctacaaattatttttaaattgatttcctttccttagagctgcaggagaatatctggcaaagagcatttaa

SEQ ID NO: 114 - DNA, 735 bp, Homo sapiens
gctgcccctgaaccccagaacaaccagctggatcagttctcacaggagctacaggccggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattc

SEQ ID NO: 115 - DNA, 1613 bp, Homo sapiens
ggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggggctggcgctgcaaccggtgtacccgggggccggcgccggctcctcgggtggctacttcccggggaccgggctttcagtgcctgcggagtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacaggggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataaaaaaaaaaaaaaaaaaaaaa

SEQ ID NO: 116 - DNA, 815 bp, Homo sapiens
gcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttcttttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttataaaaaaaaaaaaaaaaaaa

SEQ ID NO: 117 - DNA, 2971 bp, Homo sapiens
  modified_base (237)..(237): a, c, g, t, unknown or other
  modified_base (297)..(301): a, c, g, t, unknown or other
  modified_base (314)..(314): a, c, g, t, unknown or other
  modified_base (575)..(575): a, c, g, t, unknown or other
  modified_base (770)..(770): a, c, g, t, unknown or other
  modified_base (788)..(788): a, c, g, t, unknown or other
  modified_base (862)..(862): a, c, g, t, unknown or other
  modified_base (864)..(864): a, c, g, t, unknown or other
  modified_base (1086)..(1086): a, c, g, t, unknown or other
  modified_base (2352)..(2352): a, c, g, t, unknown or other
tgatgatgattttggggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaacctnttaataattttctgtgctaagggtccagtatttatttgattatttagtatgtttatgttnnnnnacactaatttagntcttttgatacattttacattctgtttactgccacaagcactgtggcaataacttttgaattttaatttttataatagaaaaatgattaggaattgctagatagtgttttgaaagcatatctttttcttcagaacaatgtagacttccaaaatggttaacctaaggggtctttacaaaatgtgttataagttaaacataatttgggaagttttacttttgttttcttctatgaagaaaaaaatgcaggctgggcgcggtgnctcacgcctgtaatcctagcactttgggaggccgaggcaggtggatcacctgaggtcagttcaagaccagcctggccaacatggtgaaaccccgtctctactaaaaatacaaaaattagctgggcgtggtggcatgcgcctgtaatcccagctacccaggaggctgaggcaggagaattgctgaaacccgggagncagaggctgcagagagcncgagactgggccactgcactccagcctggatgacagagtgagactccgtctcaaaaaaaaaaaaaaaaaaaggnanaaaaaaaaaagaaaaaaaaccatatgtgtattagggtgactgagtggtgacttcatttataataatacagagaatagctataagctcattgacagtaaaaacaacaaaccaggattctactgtttgaaaagaagtttcgttttaattttggaatttagaatgtgtatttgcaaagtcaccaattttcatctaaaaggttatattctagttgtgtcaccaaancatcaaaaaaccttaaaaaagaagtaacttgctttgtaggtttgtattgttgatctaaacctgatacatgcttcatttaatcaggaataatccttttttttctgctggacatgtataaatttcactggattgtataaatttttatctattgccttaaacatttacatgattctcaatatgttttagctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgtttnggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtatgtggttaattataaataaaactggtaccagaaaaaaaaaaaaaaaaaa

SEQ ID NO: 118 - DNA, 480 bp, Homo sapiens
  modified_base (23)..(23): a, c, g, t, unknown or other
  modified_base (26)..(26): a, c, g, t, unknown or other
  modified_base (30)..(31): a, c, g, t, unknown or other
  modified_base (41)..(41): a, c, g, t, unknown or other
  modified_base (45)..(46): a, c, g, t, unknown or other
  modified_base (52)..(52): a, c, g, t, unknown or other
  modified_base (56)..(57): a, c, g, t, unknown or other
  modified_base (68)..(68): a, c, g, t, unknown or other
  modified_base (82)..(82): a, c, g, t, unknown or other
  modified_base (100)..(100): a, c, g, t, unknown or other
  modified_base (163)..(163): a, c, g, t, unknown or other
tttccttcaacggtgccagtggnctntggnncaatttaatntttnnaaattnaacnngctgcagaacntgggaacattttanggttctcatccatggcantggtacttcagtcaaggatttccagttatcttgggtactcacttacccttctttattcatggntgctatctagcaccaaagagataccggatacttttggtgactgtgctgtggacactgcttgtttataggtaagattttatttgttcaaaaggctaaaattttttatgttaccaagaaatcaaattaaattcttcaaaaagtaaactttatgttttggaggtgccattaacttttgttagtgggaattatcttagaagatacaagtagtagtaattatggaggcactagagtgaatactttagatatgtagtttgcttaataaggattacactcaatttttaagaacttggactaattttatttgctttaaaaaaaaa

SEQ ID NO: 119 - DNA, 1003 bp, Homo sapiens
  modified_base (223)..(223): a, c, g, t, unknown or other
  modified_base (977)..(982): a, c, g, t, unknown or other
caacctggagttattttggttgactatgtcctggctttggcttctcctggcaggaagtcatcaggcatcctctccaggtgagccgaaattccaccctcccaggttggacatcatcttttaaacccaatggtctactcccctccttctttatgaaacagtgatttcccgtgagtaactctggttctgattttttgtaccggcgcttaaattctttctgtagacnttggaaagccacaaagaacgtgactgcagtgagcctcccactggagcagccttaaccaacactttggccaaagcccccccacctcccctgtgtactgtgtgtgtgtttggtggatacagtattccttttcagtgtccctaaagctgtgatggggagtccccacttacctagaaagcattaccagtcacctactctgcattctcagatgtaaaccttgtgtagtgttctttttgcaatgacctatttatttaacctatttatatttatttaatttttactctgaaatgtatccagttacaattgtacttgcttaaagcacatcagatttgttttggacaacacccttgaccattttaaaactggaaaagtgatactgtatccttccatgggatggatgctttacagtagtcttattattaaagggtgattaatttggtcggggtaaaatgttaatttttaggtgatttttaagaattctgtgccattatgtcttctgtgtggatggttaattgtttaattagtacgtgttaattgtgtgatacagtcttctttgtggaacccaaaatcctctttttagctttatattttataaactgccagattgtacaacttttatgtgcatttttaaagcttgaagacatgagggtcattatctaagttaaacagcctatttttgtgcctcctgtacagttttataattctgctgatggcggcatcttatgtcgagccaaccacaataaaggtagttttagannnnnnaaaaaaaaaaaaaaaaaaaaa

SEQ ID NO: 120 - DNA, 662 bp, Homo sapiens
accgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgct

SEQ ID NO: 121 - DNA, 4648 bp, Homo sapiens
ctgaattgaacaacagtcttcatccaacactccaaaccagttggcagggtaggacccttggtgtggggtgttggatgaagactgttgttcaattcaggggccggtggggctgagggtttctgtgggggaagacctgataccgccaggccccgaagcccttcaggagccagtcggtgggggtcctcacttacagggtaaaaacggggtctctgaggtgggccctgaccaggaaacgctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtgaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaaaaaaaaaaaaaaaaaa

SEQ ID NO: 122 - DNA, 1710 bp, Homo sapiens
ggggctggcaagcgcttcctgcgcagcgccgaggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcatagtacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggccatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctctcaaaaaaaaaaaaaaaaaaaaaaaaaaaaaa

SEQ ID NO: 123 - DNA, 764 bp, Homo sapiens
cccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctggccaggacgctgtcatcgtgctgctgggcacccgcaatgacctcagtcccacgacagttatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctggacatgaggagcaaaggaagggggcaataaatgttgagccaagagcttcaaattactctag

SEQ ID NO: 124 - DNA, 2156 bp, Homo sapiens
ggcacgagggtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaaattcggtgcacacagactgacatgaaacctgggtgctacagtaaaagaaaacaaaagtccagtttgtgtctcttaatcgctcacttcaactcatttcttctaaataaactatttaatatcctgaaaaaaaaaaaaaaaaaa

SEQ ID NO: 125 - DNA, 873 bp, Homo sapiens
cagtttgaatcgcggtgcgaccgaaggagtaggtgctgggatcgtcaccgtggcaccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgttcagaccttatttccactctggtggataagttcaataaaggtcatatcccaaactaaaa

SEQ ID NO: 126 - DNA, 808 bp, Homo sapiens
gcgctccggaaggcgccctccagtgggaggttgctcaggggatggcggagctgtgaaactcggagctagaaggaaagtctcaacgcttgtctaaattttgctttgtcgtgacgagctacctagacccacgcagagctaacttgggagagcgcttgtgacgctacgaacctctcgaacacctgacgactgggcgccagggccggatggagggtggagagccagtgcggcgcagctgcctcctcttaaccgggacaccttgcaggaatgtgcggagtggagctaacgggagcggatagaaaccgagggaggggaagagagcgcgaaggcttggccggaaggagaggttaaaaaggaaaggcctaaaatgaggaagagagttaccacaacaagcagtacctagttccagttcttggtcccaggagtttgtggttgttgctgctttcatcttcctcagccaacacaaaaggaaagtgccaaggggcgattcctaggaccttcagtgcagtctccaccttgcggacttggctcatttgtgtccactcctttctccagccttttacacttgatgctcttggatgaatagaaaggagcacaattaatggaaaacacaagcttgggagtcaagggatttgggttctattcttgtcctcccttggtgacgacatcattaccttgggttattcaagctttcagtgccagagttcctatatcaataaaagattattacattgacctcttagagaaatgttttcatggtactgaattgcaaataaagtatgtgtagcgatgtgttaaaaaaaaaaaaaaa

SEQ ID NO: 127 - DNA, 468 bp, Homo sapiens
  modified_base (6)..(6): a, c, g, t, unknown or other
  modified_base (9)..(10): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (30)..(30): a, c, g, t, unknown or other
  modified_base (33)..(33): a, c, g, t, unknown or other
  modified_base (36)..(36): a, c, g, t, unknown or other
  modified_base (39)..(39): a, c, g, t, unknown or other
  modified_base (42)..(42): a, c, g, t, unknown or other
  modified_base (45)..(45): a, c, g, t, unknown or other
  modified_base (51)..(51): a, c, g, t, unknown or other
  modified_base (57)..(57): a, c, g, t, unknown or other
  modified_base (60)..(60): a, c, g, t, unknown or other
  modified_base (71)..(72): a, c, g, t, unknown or other
  modified_base (75)..(75): a, c, g, t, unknown or other
  modified_base (78)..(78): a, c, g, t, unknown or other
  modified_base (93)..(93): a, c, g, t, unknown or other
  modified_base (99)..(99): a, c, g, t, unknown or other
  modified_base (129)..(129): a, c, g, t, unknown or other
  modified_base (132)..(132): a, c, g, t, unknown or other
  modified_base (135)..(135): a, c, g, t, unknown or other
  modified_base (138)..(138): a, c, g, t, unknown or other
  modified_base (148)..(150): a, c, g, t, unknown or other
  modified_base (153)..(153): a, c, g, t, unknown or other
  modified_base (156)..(156): a, c, g, t, unknown or other
  modified_base (159)..(159): a, c, g, t, unknown or other
  modified_base (291)..(291): a, c, g, t, unknown or other
  modified_base (294)..(294): a, c, g, t, unknown or other
  modified_base (318)..(318): a, c, g, t, unknown or other
  modified_base (321)..(321): a, c, g, t, unknown or other
  modified_base (331)..(331): a, c, g, t, unknown or other
  modified_base (333)..(333): a, c, g, t, unknown or other
  modified_base (339)..(339): a, c, g, t, unknown or other
  modified_base (384)..(384): a, c, g, t, unknown or other
  modified_base (387)..(387): a, c, g, t, unknown or other
  modified_base (405)..(405): a, c, g, t, unknown or other
  modified_base (414)..(414): a, c, g, t, unknown or other
  modified_base (448)..(448): a, c, g, t, unknown or other
  modified_base (451)..(451): a, c, g, t, unknown or other
  modified_base (454)..(454): a, c, g, t, unknown or other
  modified_base (458)..(458): a, c, g, t, unknown or other
atggtncanntnacnccngtggagaagtcngcngtnacngcnctntggggnaaggtnaangtggatgaagnnggnggngaggccctgggcagnctgctngtggtctacccttggacccagaggttcttngantcnttnggggatctgnnnacnccngangcagttatgggcaaccctaaggtgaaggctcatggcaagaaagtgctcggtgcctttagtgatggcctggctcacctggacaacctcaagggcacctttgccacactgagtgagctgcactgtgacaagctncangtggatcctgagaacttcaggctnctnggcaacgtgntngtctgngtgctggcccatcactttggcaaagaattcaccccaccagtgcangcngcctatcagaaagtggtngctggtgtngctaatgccctggcccacaagtatcactaagctngcnttnttgntgtccaattt

SEQ ID NO: 128 - DNA, 624 bp, Homo sapiens
acactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaacttc

SEQ ID NO: 129 - DNA, 3337 bp, Homo sapiens
  modified_base (1813)..(1813): a, c, g, t, unknown or other
  modified_base (3049)..(3049): a, c, g, t, unknown or other
  modified_base (3063)..(3063): a, c, g, t, unknown or other
acgcggcctgctcaggcctccagcggccggtcggaggggaggcgggaggcgagcgaggacccgcgcccgcagtccagtctgtgcgcgcccgtgctcgcttggcgcggtgcgggaccagcgccggccacccgaagcctagtgcgtcgccgggtgggtgggcccgcccggcgccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcanagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctgggtatggggtggggggcgggcactggactggaaatgccctctgcagcctcaagaggtgcgagccttctgaatatgcagtcactggggctgtggacctgggactgcctgcagggtcactgggctcctttaattcacctaaactcaggccctccaagcggggccatggagaggagccccacgtggggtgaggctgctgaactctggggttcccacattctccttcccttcaggatccgccacaaacagacactttttgcttccttaaagtaggatcaaatctagatcctctagcctgggcagtagaggaagaaatgctagcctggaagctcggcatttggtttcactaagggccatgtggttccctgcagcctcatgcctggccccttgacacatccaaagcaaagggagtcctgccccctccccccacttcctttctaccctgcctgtgcacagtgggtgggttggtgtnttctggacactgangacttcctcccccttttgcctgtccttccctccggccctgtgtgcctcagggcagatatagcaagctctttcgaccatagttgatggtaggacattttagactttgtttctcagctctgtacaaacacaaatacacacccccacaaaactaaaatcaaagtttcactacataacactgggccttactgcatgtggttcattctagcatttctgttctgtgctgtgctaagctatactactgtatgttctttcagtaaaaaaaaaaaaaaaaaaa

SEQ ID NO: 130 - DNA, 876 bp, Homo sapiens
  modified_base (22)..(22): a, c, g, t, unknown or other
  modified_base (830)..(830): a, c, g, t, unknown or other
  modified_base (840)..(853): a, c, g, t, unknown or other
  modified_base (855)..(860): a, c, g, t, unknown or other
  modified_base (862)..(862): a, c, g, t, unknown or other
  modified_base (864)..(864): a, c, g, t, unknown or other
  modified_base (866)..(867): a, c, g, t, unknown or other
  modified_base (869)..(869): a, c, g, t, unknown or other
ggactcaccgctagcccgcagngctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaanaaaaaaaaannnnnnnnnnnnnnannnnnncntntnncngttattt

SEQ ID NO: 131 - DNA, 1015 bp, Homo sapiens; identical to SEQ ID NO: 103
  modified_base (144)..(144): a, c, g, t, unknown or other
  modified_base (703)..(703): a, c, g, t, unknown or other
  modified_base (937)..(937): a, c, g, t, unknown or other
  modified_base (1010)..(1010): a, c, g, t, unknown or other

SEQ ID NO: 132 - DNA, 1646 bp, Homo sapiens
tagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgagacgggaccagaagagctgaatacttctgtctaccaccccataaatggatcaccagattatcagaaagcaaaattacaagttcttggggccatccagatcctgaatgcagcaatgattctggctttgggtgtctttctgggttccttgcaatacccataccacttccaaaagcacttctttttcttcaccttctacacaggctacccgatttggggtgctgtgtttttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaactatctctaccatagccatgtggtgcaatgcaaactgctgtaattcaagagaggaaatttcctcacctcccaattctgtgtaatcaagaatacctccttatgaaaataattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 133 - DNA, 1658 bp, Homo sapiens
ggcacgagctcggctcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttaaaaaaaaaaaaaaaaaaa

SEQ ID NO: 134 - DNA, 836 bp, Homo sapiens
gtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaatt

SEQ ID NO: 135 - DNA, 3885 bp, Homo sapiens
ccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcggggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactgctctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagct

SEQ ID NO: 136 - DNA, 1140 bp, Homo sapiens
  modified_base (13)..(13): a, c, g, t, unknown or other
gggagtgagcggngcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctcttaaaaaaaaaaaaaaaaaaaaaaaaaaaaaaaaaaa

SEQ ID NO: 137 - DNA, 961 bp, Homo sapiens
  modified_base (130)..(130): a, c, g, t, unknown or other
tcttctgtgcttcaccatctacataatgaatcccagtatgaagcagaaacaagaagaaatcaaagagaatataaagaatagttctgtcccaagaagaactctgaagatgattcagccttctgcatctggntctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaa

SEQ ID NO: 138 - DNA, 2826 bp, Homo sapiens
  modified_base (64)..(66): a, c, g, t, unknown or other
  modified_base (68)..(68): a, c, g, t, unknown or other
  modified_base (70)..(70): a, c, g, t, unknown or other
  modified_base (72)..(74): a, c, g, t, unknown or other
  modified_base (76)..(80): a, c, g, t, unknown or other
  modified_base (82)..(83): a, c, g, t, unknown or other
  modified_base (202)..(202): a, c, g, t, unknown or other
  modified_base (684)..(684): a, c, g, t, unknown or other
  modified_base (719)..(720): a, c, g, t, unknown or other
  modified_base (722)..(723): a, c, g, t, unknown or other
  modified_base (725)..(726): a, c, g, t, unknown or other
  modified_base (728)..(728): a, c, g, t, unknown or other
  modified_base (731)..(735): a, c, g, t, unknown or other
  modified_base (748)..(748): a, c, g, t, unknown or other
  modified_base (792)..(792): a, c, g, t, unknown or other
  modified_base (1142)..(1142): a, c, g, t, unknown or other
  modified_base (1984)..(1984): a, c, g, t, unknown or other
  modified_base (2681)..(2691): a, c, g, t, unknown or other
  modified_base (2696)..(2704): a, c, g, t, unknown or other
caaagtgtctagtagacagataaaaaaatagactagttctagatcgcgagcggcccccggaggnnntncngnnngnnnnngnngagccccggcgcggagcaggcgggggacggtattcagaattcgagcgcaggagctccgcttctccacctgctcccggggagctattgggatccagagaatcacccgctgatggtttttncccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgcnacactcatcatagccttcacctctgcaggctcagnngnncnncnctnnnnngccatgccaatgntcaccattgggggaatcctgtttctcatcaccaacctgcagatngggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagangcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagnaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaaaaaaaaaaaaaaaaannnnnnnnnnnaaaannnnnnnnnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 139 - DNA, 2740 bp, Homo sapiens
gcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgtggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgctcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcagacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttacgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagtcctagaggatccctac

SEQ ID NO: 140 - DNA, 3379 bp, Homo sapiens; identical to SEQ ID NO: 87

SEQ ID NO: 141 - DNA, 2917 bp, Homo sapiens
ggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctg

SEQ ID NO: 142 - DNA, 2031 bp, Homo sapiens
ggcacgaggcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaaaaaaaaa

SEQ ID NO: 143 - DNA, 3482 bp, Homo sapiens
  modified_base (48)..(48): a, c, g, t, unknown or other
  modified_base (570)..(570): a, c, g, t, unknown or other
  modified_base (669)..(669): a, c, g, t, unknown or other
  modified_base (675)..(675): a, c, g, t, unknown or other
  modified_base (680)..(680): a, c, g, t, unknown or other
  modified_base (835)..(835): a, c, g, t, unknown or other
  modified_base (876)..(876): a, c, g, t, unknown or other
  modified_base (1499)..(1499): a, c, g, t, unknown or other
  modified_base (1501)..(1501): a, c, g, t, unknown or other
  modified_base (1503)..(1507): a, c, g, t, unknown or other
  modified_base (1509)..(1510): a, c, g, t, unknown or other
  modified_base (1512)..(1517): a, c, g, t, unknown or other
  modified_base (1598)..(1598): a, c, g, t, unknown or other
  modified_base (1604)..(1604): a, c, g, t, unknown or other
  modified_base (1671)..(1671): a, c, g, t, unknown or other
  modified_base (1673)..(1673): a, c, g, t, unknown or other
  modified_base (1766)..(1766): a, c, g, t, unknown or other
  modified_base (1783)..(1783): a, c, g, t, unknown or other
  modified_base (1922)..(1922): a, c, g, t, unknown or other
  modified_base (2475)..(2475): a, c, g, t, unknown or other
  modified_base (2514)..(2514): a, c, g, t, unknown or other
  modified_base (2768)..(2768): a, c, g, t, unknown or other
  modified_base (3459)..(3460): a, c, g, t, unknown or other
gggtggagtgtaggccagggggttggcggtgccgtgtcatggaggctnagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaancttcgaaaattggagcttagtgataatataatttctggaggcttggaagtcctggcagagaaatgtccaaatcttacctacctcaatctgagtggaaancaaaantaaanagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggatnatgaagcgccggactctgaagaggaggatgatgaggatggngatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttananannnnnannannnnnnatttcattccttatttataaattaactgaaattacagtttgctataatataaaatgacaatagtctcttgagtggtaagtnggttanttttttagaggtgatccaggaatctttagtttgaaggcagttacctttttttttttttttttttttngnctaagagtgtttggttgcttttttgtcacaagtaacttggaaaatagaagcagaatagtaaaggttctattcagcaacatagttcatggattntgtggaggttctattcngtaatatggttcatggatttagtggtgactgataagattttatttttgaaggaaaaattgcttatactaagtccagagacatgcaggtgagcccttttgtcaggctgcaaatcatgacatgccgatggttgtttatttngtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaaganttgttttcaagtggatgtccattaaaagtagaaaaatanttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgnttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgannaaaaaaaaaaaaaaaaaaaaaa

SEQ ID NO: 144 - DNA, 2568 bp, Homo sapiens
gtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtg

SEQ ID NO: 145 - DNA, 777 bp, Homo sapiens
  modified_base (21)..(26): a, c, g, t, unknown or other
  modified_base (31)..(33): a, c, g, t, unknown or other
  modified_base (50)..(52): a, c, g, t, unknown or other
  modified_base (63)..(63): a, c, g, t, unknown or other
  modified_base (432)..(432): a, c, g, t, unknown or other
  modified_base (721)..(721): a, c, g, t, unknown or other
  modified_base (723)..(723): a, c, g, t, unknown or other
  modified_base (725)..(731): a, c, g, t, unknown or other
  modified_base (733)..(733): a, c, g, t, unknown or other
  modified_base (735)..(735): a, c, g, t, unknown or other
  modified_base (737)..(739): a, c, g, t, unknown or other
atcgcgtccgccgggctgggnnnnnngcgcnnnggctaggaagaggccgnnnggggcgaaggnggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattngactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttaananannnnnnnananannnctgggatgtgggaaaataaattacactgaagcagttga

SEQ ID NO: 146 - DNA, 654 bp, Homo sapiens
gaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtc

SEQ ID NO: 147 - DNA, 849 bp, Homo sapiens
tagtcacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttggaagaaaacgagactcagaaagaagttccacaggaccagcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttaaaaaaaaaaaaaaaaaa

SEQ ID NO: 148 - DNA, 2154 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccagaccttttgagttcaactgatcaaaccaaaggaaaagtgttgctagagaaaattggggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggta

SEQ ID NO: 149 - DNA, 2652 bp, Homo sapiens
  modified_base (126)..(126): a, c, g, t, unknown or other
  modified_base (290)..(290): a, c, g, t, unknown or other
  modified_base (292)..(292): a, c, g, t, unknown or other
  modified_base (1557)..(1557): a, c, g, t, unknown or other
  modified_base (1559)..(1559): a, c, g, t, unknown or other
  modified_base (1781)..(1781): a, c, g, t, unknown or other
  modified_base (2458)..(2458): a, c, g, t, unknown or other
tggatattcggataaaaacaaccaaacaaaaaactggctaaatacccattcccctcaataacttggataagatacctaaaaaaggtcgaccttcggtacctttctgtcttctcccctctcgctatntgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacangngggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattacntngaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaanctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgnatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaaaaaaaaaaaaaaaaaaaaaaaaaaaaaaaa

SEQ ID NO: 150 - DNA, 1085 bp, Homo sapiens
  modified_base (22)..(22): a, c, g, t, unknown or other
  modified_base (24)..(24): a, c, g, t, unknown or other
  modified_base (30)..(30): a, c, g, t, unknown or other
  modified_base (635)..(635): a, c, g, t, unknown or other
  modified_base (654)..(654): a, c, g, t, unknown or other
  modified_base (909)..(909): a, c, g, t, unknown or other
  modified_base (1051)..(1055): a, c, g, t, unknown or other
ccggcacgggtcgcagtgaggngnctcggncatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaancgcagggactcctaggggncccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacaggnccacagccccctcaggcagccaggtcatctgagtatcattaagagtagtgatgggaagattacagtctgagggccaaacgtgcctgcttcctgtttttgtaaataaagttttgttggaacacaaaaaaaaaaaaaaaaaaannnnnaaaaaaaaaaaaaaaaaaaaaaaaaaaaaa

SEQ ID NO: 151 - DNA, 2062 bp, Homo sapiens
gtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggc

SEQ ID NO: 152 - DNA, 835 bp, Homo sapiens
cgtgagctcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttaacagactaatggagttgcaatttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacagctctgtgtggcttttggacaaattaaagctagttttggtaaaaaaaaaaaaaaaaa

SEQ ID NO: 153 - DNA, 2514 bp, Homo sapiens
ctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctccgtgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagcgtgccggagactgggacaagcagcctgtcaaggtgcctgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcggggctgcacacccagcagcagcgcacgcctccgaagcctgcggcctcgcttgaaggaggcgtcgccggaaacccagggaacctctctgaagtgacacctcacccctacacaccgtccgttcacccccgtctcttccttctgcttttcggtttttggaaagggatccatctccaggcagcccaccctggtggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggcggcggcacagcctgggcctccccttccctcaagccagggctcctcctcctgtcgtgggctcatttgccaggctcaggccaggtctggacagctgtgactctcctcaagccaggactaccgaccagccggctatgggcacattacgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 154 - DNA, 1882 bp, Homo sapiens
gaattcgggcgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctactttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggaaaaaagaaaaaaaaaaaaaggaattc

SEQ ID NO: 155 - DNA, 2271 bp, Homo sapiens
  modified_base (12)..(15): a, c, g, t, unknown or other
  modified_base (17)..(25): a, c, g, t, unknown or other
  modified_base (28)..(29): a, c, g, t, unknown or other
  modified_base (32)..(32): a, c, g, t, unknown or other
  modified_base (34)..(35): a, c, g, t, unknown or other
  modified_base (38)..(40): a, c, g, t, unknown or other
  modified_base (42)..(43): a, c, g, t, unknown or other
  modified_base (1687)..(1687): a, c, g, t, unknown or other
  modified_base (1835)..(1848): a, c, g, t, unknown or other
  modified_base (1885)..(1885): a, c, g, t, unknown or other
  modified_base (1915)..(1915): a, c, g, t, unknown or other
  modified_base (2009)..(2009): a, c, g, t, unknown or other
  modified_base (2011)..(2011): a, c, g, t, unknown or other
  modified_base (2029)..(2029): a, c, g, t, unknown or other
  modified_base (2154)..(2154): a, c, g, t, unknown or other
  modified_base (2165)..(2165): a, c, g, t, unknown or other
  modified_base (2175)..(2175): a, c, g, t, unknown or other
  modified_base (2194)..(2194): a, c, g, t, unknown or other
  modified_base (2219)..(2220): a, c, g, t, unknown or other
  modified_base (2226)..(2226): a, c, g, t, unknown or other
  modified_base (2228)..(2228): a, c, g, t, unknown or other
  modified_base (2245)..(2245): a, c, g, t, unknown or other
agcgccgtaccnnnncnnnnnnnnntgnntantnnggnnngnnggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattngtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatcnnnnnnnnnnnnnnactgtaaaattatttacttttttaaacattttaagtngtattttttgagcataaattcgattttttnaggtggaaatctgaaaaatcaatacaactagaaagaaaaatagtacacagtgttatcatctagagctgatttttatttcacacctctgggtatngntctttttcctctcgagtnagtttttttatccataggtgagatatatagtaagtttttaaggcaaagtatttcttaggcttaagtttccttattttaaaaatagggtaatatgccctatctatctcctaattcctccatgaatngaggattacantgtgatgttngcaatgtggtatatgtgtntagcagtacagatgctcaataaggnntagcancntatgttgactcaggttntttccaaaaaaaaaaaaaaaaaaaaa

SEQ ID NO: 156 - DNA, 1231 bp, Homo sapiens
aggtctcagccggtcgtcgcgacgttcgcccgctcgctctgaggctcctgaagccgaaactagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctattttttttctctattctctccaatttgtttaaagaataaagtccaaagtctgatctggtctagttaacctagaagtatttttgtctcttagaaatacttgtgatttttataatacaaaagggtcttgactctaaatgcagttttaagaagtgtttttgaatttaaataaagttacttgaatttcaaac

SEQ ID NO: 157 - DNA, 1900 bp, Homo sapiens
  modified_base (16)..(16): a, c, g, t, unknown or other
  modified_base (40)..(40): a, c, g, t, unknown or other
  modified_base (101)..(101): a, c, g, t, unknown or other
  modified_base (112)..(112): a, c, g, t, unknown or other
  modified_base (114)..(114): a, c, g, t, unknown or other
  modified_base (376)..(376): a, c, g, t, unknown or other
  modified_base (469)..(469): a, c, g, t, unknown or other
  modified_base (508)..(508): a, c, g, t, unknown or other
  modified_base (600)..(600): a, c, g, t, unknown or other
  modified_base (607)..(607): a, c, g, t, unknown or other
  modified_base (613)..(613): a, c, g, t, unknown or other
  modified_base (615)..(615): a, c, g, t, unknown or other
  modified_base (624)..(624): a, c, g, t, unknown or other
  modified_base (632)..(632): a, c, g, t, unknown or other
  modified_base (636)..(637): a, c, g, t, unknown or other
  modified_base (647)..(647): a, c, g, t, unknown or other
  modified_base (649)..(649): a, c, g, t, unknown or other
  modified_base (651)..(651): a, c, g, t, unknown or other
  modified_base (659)..(659): a, c, g, t, unknown or other
  modified_base (661)..(661): a, c, g, t, unknown or other
  modified_base (1455)..(1455): a, c, g, t, unknown or other
  modified_base (1576)..(1576): a, c, g, t, unknown or other
  modified_base (1730)..(1730): a, c, g, t, unknown or other
  modified_base (1862)..(1862): a, c, g, t, unknown or other
tagctttggtaaatangacatatctgctacaaaagatggntggatgtttcatataccttctcttcttcacattttaaaatattttgttttctttttttgtnaaaatttagtncnagcgtgcagcaccatgagaatacaatagaatggtagagtgactgacttaagctaataataacattctaagattaattgaaacataaatgacccccagaacaaatatctgagtgacaaaaattctggtctttaaaaatgttatctatagttagataaagtttggggcagtggaggctatcttaaaattaatcatccaatgaatatcagcaatggatttacagttttccctctgactttctaggttgtcctggaaaagacctangtgtttctgtagatctgggctcctaaaactctctccgaaaaataataaactagaagggtgctagatatatgttcagtgatgattagaatcttnaacattaaacaattattgtttaaaagcaataaatctggnctatattctgtccatggctcatatgtatttaaaaagaatggaaagaattttgagagtaaattttttgaatgttattttccttttaaattggnaacttanattggntnatccttaangacatggntggnnaaccactggnananggaaatcnantacccaatgcctttgagaaattgttaagctacattattggttctctaagaaatagcagtttatagatgacattttagaaaagcaagctcctatcttaccagaggcttacacaggggtgactctgcaaatacatgtaaacaaagtggaattggtgtgagtttgttttaattccaacagctgatgatgctaagtagaaacctagtgaaacaacccttaataaataaaaagcaatagtttgttcccccagtttaattcagtaaatattaagtattaataacatgtgatggaaatagtatctgaaattctcagcctgtggtctggccttgctcttagaggaagaagatgcctctcttccaagttctgattatggtttatgtgacctttggttaataggttaggaggtcagatttgccagaaaaccagtggcaccgtggttgttccaggaggatattttgtcatgttcattaaaagtcctacaagaaaggtgacacatgcttatcccaactttacagtaagtcaagcaaaggaagttctcatgagaaagttggattaaacaaacagcagcaactacaatcgtataaggtttagtggatttttactcctttccgctgcaaaggagtgcaaaagaggaatgtctctaacactaggtaattatgctttttatgttttttctcttgtgtggcactctgcctgattttattacaacaaaacatttatgtttctgtattatgtgtgtgtgtatatgtattttatatatatgcattttccgtcccaccctgccaagtcatgatttnttatgcactgaacgtaggggcattagagtagaaggttgcctcaggttagttttgtgtggggttgaatgccttttatttctgacttcatttctatctgccaatggatcaatgcattttactntatattatcaaaatacaatatagtgtaagaagtggatcctggctaggtgcagtggctcatgcctgtaatcctagcactttgggaggctgaggcaggaggattccttgagcccaggagtctgagaccagcctgggcaacatagggagactctgtntctgcaaaaaaaaatttaaaaattagccaggtgtcatgagacacacctgtagtcccagctactgagaggctgaggtggaagagttgcttgaacccaggagtttgaagctgcagtgagctgtgatcacaccantacactccagcctggacaacagaataagaccctgtctc

SEQ ID NO: 158 - DNA, 4221 bp, Homo sapiens
cgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctt

SEQ ID NO: 159 - DNA, 1000 bp, Homo sapiens
gtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaaggtgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaaaaaaagccctcctatgaccctgaaacagatcctagtgagggattgatgaatgttttaaagaaaatttatgaagatggagcgatgatatgaagcgaaccattaataaagcctgggtggaatcaagagagaagcaagccaaaggagacccggaattttgagactttaaagtcgttttgggaactgtgatgtgatgtggaaatactgatgtttccagtaagggaatattggtgagctgcatatataaatttgacagatagctatttacatagccttttaagtaaaggcaatgaattttccatttcctactggaggatttatttaaataaaatatgcttattaaactctcctgcaaagatggaaaaaaaaaaaaaaaaaaaaaagtaaaaaaaaaaaaaaaaaaaaaaaaaaaaaaa

SEQ ID NO: 160 - DNA, 3333 bp, Homo sapiens
acgcgtccgagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaaaaaaaaaaaaaaaaa

SEQ ID NO: 161 - DNA, 1327 bp, Homo sapiens
gagcccggcagctcaatgacaaatcggtggaggacggctggggtccggccccgggagggcccggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagct

SEQ ID NO: 162 - DNA, 1547 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaa

SEQ ID NO: 163 - DNA, 2178 bp, Homo sapiens
ccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatgaaaaaaaaaaaaaaa

SEQ ID NO: 164 - DNA, 5010 bp, Homo sapiens
ggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggttcgcttactttgagtgatcctccaacttcatttgatgctaaataggagataccaggttgaaagacctctccaaatgagatctaagcctttccataaggaatgtagcaggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccatttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagcagcatacatttataatgtttgctattgacaagtcattttaatttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcatataaacgtgtagtacagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagtagggccttttggaggtaaaggtata

SEQ ID NO: 165 - DNA, 2877 bp, Homo sapiens
ctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagaaggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataagccaaaa

SEQ ID NO: 166 - DNA, 1536 bp, Homo sapiens
ggggggggggggaccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagcttgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttatagttgttttatatgttgctataataaagaagtgttctgc

SEQ ID NO: 167 - DNA, 1536 bp, Homo sapiens; identical to SEQ ID NO: 166

SEQ ID NO: 168 - DNA, 2362 bp, Homo sapiens
ggaattccaaaaaaaaaaaatacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggcagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgagatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaac

The invention claimed is:

1. A method of determining whether a first population of human cells comprises $CD34^+CD38^-Lin^-$ hematopoietic stem cells, comprising the steps of:
    (a) enriching the first population of cells for cells displaying the CD34 antigen in a bone marrow, peripheral blood, or umbilical cord blood sample;
    (b) determining the level of expression of CEBPB, GATA3, HLF, HOXA3, HPIP, KLF2, KLF4, MDS1 and NRIP1 in the population of cells of (a),
    wherein higher expression of CEBPB, GATA3, HLF, HOXA3, HPIP, KLF2, KLF4, MDS1 and NRIP1 in the first population of human cells compared to a control human $CD34^+CD38^+Lin^+$ hematopoietic progenitor cell population indicates that the first population of cells comprises $CD34^+CD38^-Lin^-$ hematopoietic stem cells.

2. The method of claim 1, wherein determining the level of expression of CEBPB, GATA3, HLF, HOXA3, HPIP, KLF2, KLF4, MDS1 and NRIP1 comprises determining the amount of CEBPB, GATA3, HLF, HOXA3, HPIP, KLF2, KLF4, MDS1 and NRIP1 mRNA.

3. The method of claim 1, wherein the higher expression in the first population of cells compared to the control cell population is by at least a factor of two.

4. The method of claim 1, wherein said first population of cells is cultured prior to determining the level of expression of the genes.

5. A method of determining whether a cultured cell suspension derived from bone marrow, cord blood, mobilized peripheral blood or non-mobilized blood is substantially enriched in human $CD34^+CD38^-Lin^-$ hematopoietic stem cells, comprising the steps of:
    (a) enriching the cultured cell suspension for cells displaying the CD34 antigen in a bone marrow, peripheral blood, or umbilical cord blood sample;
    (b) obtaining mRNA from the population of cells of (a); and
    (c) assaying said mRNA for the presence of mRNA species that hybridize under high stringency hybridization conditions to CEBPB, GATA3, HLF, HOXA3, HPIP, KLF2, KLF4, MDS1 and NRIP1,
    wherein the presence of a level of mRNA species that hybridize specifically to CEBPB, GATA3, HLF, HOXA3, HPIP, KLF2, KLF4, MDS1 and NRIP1 that is significantly higher relative to that in control human $CD34^+CD38^+Lin^+$ hematopoietic progenitor cells indicates that said cultured cell suspension is enriched in $CD34^+CD38^-Lin^-$ hematopoietic stem cells.

6. A method of reconstituting hematopoiesis in a human subject in need thereof, comprising the steps of:
    (a) providing a cultured cell suspension of histocompatible bone marrow, umbilical cord blood, or mobilized peripheral blood;
    (b) enriching the cultured cell suspension for cells displaying the CD34 antigen in a bone marrow, peripheral blood, or umbilical cord blood sample;
    (c) obtaining mRNA from the population of cells of (b); and
    (d) assaying said mRNA for the presence of mRNA species that hybridize under high stringency hybridization conditions to CEBPB, GATA3, HLF, HOXA3, HPIP, KLF2, KLF4, MDS1 and NRIP1,
    wherein the presence of expression of mRNA species CEBPB, GATA3, HLF, HOXA3, HPIP, KLF2, KLF4, MDS 1 and NRIPI is significantly higher relative to that in control human $CD34^+CD38^+Lin^+$ hematopoietic progenitor cells which indicates that the said cultured cell suspension is enriched in $CD34^+CD38^-Lin^-$ hematopoietic stem cells; and
    (e) administering a cultured cell suspension of (a) when the level of the mRNA species of the enriched cell suspension of (d) is significantly higher than the control to the human subject in need thereof.

* * * * *